United States Patent
Bremel et al.

(10) Patent No.: US 12,374,421 B2
(45) Date of Patent: *Jul. 29, 2025

(54) BIOINFORMATIC PROCESSES FOR DETERMINATION OF PEPTIDE BINDING

(71) Applicant: IOGENETICS, LLC, Madison, WI (US)

(72) Inventors: Robert D. Bremel, Hillpoint, WI (US); Jane Homan, Hillpoint, WI (US)

(73) Assignee: IOGENETICS, LLC, Madison, WI (US)

( * ) Notice: Subject to any disclaimer, the term of this patent is extended or adjusted under 35 U.S.C. 154(b) by 69 days.

This patent is subject to a terminal disclaimer.

(21) Appl. No.: 14/895,746

(22) PCT Filed: Jun. 9, 2014

(86) PCT No.: PCT/US2014/041523
§ 371 (c)(1),
(2) Date: Dec. 3, 2015

(87) PCT Pub. No.: WO2014/200910
PCT Pub. Date: Dec. 18, 2014

(65) Prior Publication Data
US 2016/0132631 A1    May 12, 2016

Related U.S. Application Data

(60) Provisional application No. 61/833,248, filed on Jun. 10, 2013.

(51) Int. Cl.
G16B 5/00 (2019.01)
A61K 39/00 (2006.01)
(Continued)

(52) U.S. Cl.
CPC ............. *G16B 5/00* (2019.02); *A61K 39/098* (2013.01); *C07K 7/06* (2013.01); *C07K 7/08* (2013.01);
(Continued)

(58) Field of Classification Search
CPC .. A61K 39/098; A61K 2039/572; C07K 7/06; C07K 7/08; C12N 9/0051; G06F 17/16
See application file for complete search history.

(56) References Cited

U.S. PATENT DOCUMENTS 7,125,689 B2 * 10/2006 Carr ................... C07K 14/3153
435/69.1
2006/0257944 A1   11/2006 Fridman et al.
(Continued)

FOREIGN PATENT DOCUMENTS

WO     2011/119484     9/2011

OTHER PUBLICATIONS

Schneider et al. Proc. Natl. Acad. Sci. USA vol. 95, pp. 12179-12184, 1998.*

(Continued)

*Primary Examiner* — Karlheinz R. Skowronek
*Assistant Examiner* — Emilie A Neulen
(74) *Attorney, Agent, or Firm* — Casimir Jones, S.C.; J. Mitchell Jones

(57) ABSTRACT

This invention relates to the identification of peptide binding to ligands, and in particular to identification of epitopes expressed by microorganisms and by mammalian cells. The present invention provides polypeptides comprising the epitopes, and vaccines, antibodies and diagnostic products that utilize or are developed using the epitopes.

11 Claims, 23 Drawing Sheets

Specification includes a Sequence Listing.

(51) Int. Cl.
*A61K 39/02* (2006.01)
*C07K 7/06* (2006.01)
*C07K 7/08* (2006.01)
*C12N 9/02* (2006.01)
*G06F 17/16* (2006.01)
*G16B 20/00* (2019.01)
*G16B 20/30* (2019.01)
*G16B 20/50* (2019.01)
*G16B 40/00* (2019.01)
*G16B 40/20* (2019.01)

(52) U.S. Cl.
CPC ............ *C12N 9/0051* (2013.01); *G06F 17/16* (2013.01); *G16B 20/00* (2019.02); *G16B 20/30* (2019.02); *G16B 20/50* (2019.02); *G16B 40/00* (2019.02); *G16B 40/20* (2019.02); *A61K 2039/572* (2013.01); *C12Y 108/00* (2013.01)

(56) References Cited

U.S. PATENT DOCUMENTS

2007/0060518 A1* 3/2007 Liu ............... A61K 39/0008
530/327
2013/0123181 A1 5/2013 Pratt et al.
2013/0330335 A1* 12/2013 Bremel ............... G06F 19/18
424/134.1

OTHER PUBLICATIONS

Bremel et al. Immunome Res 6, 7, 1-15, 2010.*
Burden et al. Journal of Molecular Graphics and Modelling, 2005, 23, p. 481-489.*
Sette et al. Current Opinion in Immunology,2003,15:461-470.*
Irini A. Doytchinova et al.; Coupling In Silico and In Vitro Analysis of Peptide-MHC Binding: A Bioinformatic Approach Enabling Prediction of Superbinding Peptides and Anchorless Epitopes. J Immunol Jun. 15, 2004; 172 (12): 7495-7502. https://doi.org/10.4049/jimmunol.172.12.7495 (Year: 2004).*
Stevanović, S., Lemmel, C., Hantschel, M. and Eberle, U. (2003). Generating Data for Databases—The Peptide Repertoire of HLA Molecules. In Immunoinformatics: Bioinformatic Strategies for Better Understanding of Immune Function (eds Novartis Foundation, G. Bock and J. Goode). (Year: 2003).*
International Search Report & Written Opinion, International Patent Application No. PCT/US2014/041523, mailed Jan. 5, 2015.
Zhao et al. "Enhancing cytotoxic T cell repsonses with altered-peptide ligands" Arch Immunol Ther Exp 2001 vol. 49, No. 4, pp. 271-277.

* cited by examiner 10,000 random peptides

Figure 3 (Cont.)
Best peptides

```
5' TTCCCCGACGGCcctcctcgtccgacoggcaaaagatactgcatcaactcagcatccttgtccttcactcctgcagacCGCATGGAGGCCGAG
    F  P  D  G  P  P  R  P  T  G  K  R  Y  C  I  N  S  A  S  L  S  F  T  P  A  D  R  M  E  A  E
```

BIOINFORMATIC PROCESSES FOR DETERMINATION OF PEPTIDE BINDING

FIELD OF THE INVENTION

This invention relates to the identification of peptide binding to ligands, and in particular to identification of epitopes in proteins expressed by microorganisms and by mammalian cells.

BACKGROUND OF THE INVENTION

Infectious diseases, including some once considered to be controlled by antibiotics and vaccines, continue to be an important cause of mortality worldwide. Currently infectious and parasitic diseases account for over 15% of deaths worldwide and are experiencing a resurgence as a result of increasing antimicrobial drug resistance and as a secondary complication of HIV AIDS. (World Health Organization, Global Burden of Disease 2004). The field of reverse vaccinology adopts the approach of starting with the genome and identifying open reading frames and proteins which are suitable vaccine components and then testing their B-cell immunogenicity (Musser, J. M. 2006. Nat. Biotechnol. 24:157-158; Serruto, D., L. et al. 2009. Vaccine 27:3245-3250). Reverse vaccinology is an extraordinarily powerful approach, with potential to enable rapid identification of proteins with potential epitopes in silico from organisms for which a genome is available, whether or not the organism can be easily cultured in vitro. Diversity is a feature of all microbial species and most microbial species are represented in nature by many similar but non-identical strains some of which have acquired or lost metabolic traits such as growth characteristics, or antibiotic resistance. In some cases different isolates are antigenically different and do not offer cross protection to a subsequent infection with a different strain. The degree of variability between strains varies from one organism to another. Among the most variable are RNA viruses (e.g., but not limited to foot and mouth disease, influenza virus, rotavirus) which undergo constant mutation and exhibit constant antigenic drift posing a challenge to vaccine selection. Hence among the challenges to epitope mapping is to identify MHC high affinity binding peptides and B-cell epitope sequences which are conserved between multiple strains.

Vaccine development is not limited to those for infectious diseases. In Europe and America, cancer vaccine therapies are being developed, wherein cytotoxic T-lymphocytes inside the body of a cancer patient are activated by the administration of a tumor antigen. Results from clinical studies have been reported for some specific tumor antigens. However, when the diversity of cancers is considered, it is impossible to treat all cancers using a cancer vaccine consisting of only one type of tumor antigen. The diversity of cancer cells gives rise to diversity in the type or the amount of tumor antigens being expressed in the cancer cells. These antigens must be identified in order to develop therapies. What is needed are new and more efficient methods of identifying epitopes for use in developing vaccines, diagnostics, and therapeutics.

In some instances, disease can arise from an immune reaction directed to the body's own cells, known as autoimmunity. Autoimmunity can arise in a number of situations including, but not limited to a failure in development of tolerance, exposure of an epitope normally shielded from the immune surveillance, or as a secondary effect to exposure to an exogenous antigen which closely resembles or mimics the host cell in MHC or B cell binding characteristics. A growing number of autoimmune diseases are being identified as sequelae to exposure to epitopes in infectious agents which have mimics in the host tissues.

Brucellosis remains the most prevalent zoonosis worldwide and has its highest prevalence across North Africa, Middle East and Central Asia. Brucellosis is a debilitating chronic disease for people naturally infected through exposure to bacteria in milk and placental fluids of livestock. No effective vaccine exists to protect humans from brucellosis. Several weeks of antibiotic treatment are required, but may be unable to clear residual foci of bacteria. Historically, vaccines developed to control disease in cattle, sheep, and goats, the main natural reservoir, are comprised of live attenuated *Brucella* organisms, still capable of causing disease in humans and in livestock if incorrectly applied. Killed organisms are ineffective vaccines. A safe and effective vaccine is needed for veterinary use, and for prevention and potentially therapeutic use in humans.

The immune response is the consequence of many input signals including binding of epitopes to B cell receptors to initiate antibody production and the binding of peptides to MHC molecules within antigen presenting cells as pMHC complexes which are presented on the surface of antigen presenting cells to T cells, initiating a cellular response involving cytotoxic T cells and T helper cells which mediate both antibody production and cytotoxic T cell responses. Binding of the peptides to MHC molecules is a key step in the initiation of the immune response and is dependent on the genetics of the host. A short peptide may bind in either an N—C orientation or in a C—N orientation when present in a complex with an MHC groove.

A mathematical approach to further understanding of the structurally-based peptide binding mechanisms involved in immunologic and other protein based reactions and which can be implemented in silico would be of great value to the art.

Beyond the understanding of epitope structure and binding for the purposes of developing vaccines and biotherapeutics there is a broader need to be able to characterize protein interactions in binding reactions, including but not limited to enzymatic reactions, binding of ligands to cell receptors and other physiologic mechanisms.

SUMMARY OF THE INVENTION

The present invention is directed to the identification of immunogenic epitopes and the design and expression of peptides comprising epitopes with specific characteristics. It is further directed to methods for identifying and designing such epitopes and peptides comprising such epitopes. The present invention is also directed to the definition of certain antigens epitopes and peptides comprising these in *Brucella* spp. bacteria.

In some embodiments the present invention provides synthetic amino acid sequences which have been modified to increase or decrease their binding to one or more MHC molecules. In some embodiments the modifications may change the binding to one MHC allele molecule, whereas in others the changes may impact the binding to up to five different MHC allele molecules. The changes in the amino acid sequence implemented by the present invention may bring about a change of >1 or >2 standard deviation units in the relative binding affinity of a peptide to a particular MHC molecules. In some embodiments such change in binding affinity may result in higher affinity binding whereas in other embodiments it leads to a reduced binding affinity. The present invention in some embodiments, is applicable to MHC I alleles, whereas in other embodiments it is applicable to MHC II alleles. The changes in binding affinity may be the result of changes in the central core of the binding peptide or may be in the peripheral amino acids.

The present invention, which allows changes in MHC binding affinity to be introduced into peptides, may be applied to any protein, including but not limited to, from a plant protein, mammalian protein, a microbial protein, a viral protein, an allergen, an immunoglobulin, and a tumor associated antigen. In yet other embodiments the changes may be implemented in a biopharmaceutical protein, including but not limited to, a therapeutic drug protein and a vaccine.

The goals of the modifications to binding affinity implemented by the present invention may be, in one embodiment to increase the antigenicity and elicit an upregulation of the immune response, or, in the alternative, to cause a greater degree of immunosuppression or tolerization.

The present invention provides a computer implemented process for selecting amino acid changes which will specifically increase or decrease the MHC binding affinity. In some embodiments said computer implemented process involves initially developing a mathematical expression which serves as a descriptor of a peptide. Said mathematical expression is derived from multiple physical parameters of the amino acids making up the peptide. In some specific embodiments said descriptors comprise multiple principal components of the amino acid physical parameters, providing ranked and weighted uncorrelated proxies for the variance in the amino acids. Said mathematical descriptors are compared to experimentally derived datasets of peptide-MHC binding to derive predictive equations which may be applied to peptides from other proteins. In some embodiments the comparison is affected by least squares regression and is conducted by application of a neural net. In yet other embodiments the comparison may be made by application of other machine learning tools such as a support vector machine; however the choice of comparative method is not limiting. In particular embodiments the present invention can then be used to conduct simulation analyses to compare the impact on predicted binding of the substitution of various amino acids at any peptide position in order to select a change which increases or decreases predictive binding affinity. While in some specific embodiments of the present invention is directed to binding between a peptide and its ligand in the MHC molecules, it is understood that the same simulative process could be applied to other peptide ligand binding relationships and thus references to epitopes and MHC molecule binding should not be considered limiting. In some specific embodiments the simulation process may be applied to multiple amino acid sequences and may generate predictions for multiple MHC molecules. The changes predicted may be from the substitution of one or more than one amino acid. In some specific embodiments of the present invention the change in peptide ligand binding affinity may be brought about by the introduction of variant amino acids, not found within the usual 20 amino acids typically found in natural proteins.

In a previously described approach to prediction of peptide ligand binding (see, e.g., PCT/US2011/029192, incorporated by reference herein its entirety) the computer implemented description of peptides and the comparison of binding relative to a training set in order to develop predictive equations was described by reference to the sequence of amino acids in a protein processed from a starting point at the N terminal end of a peptide and progressing towards the C terminal end of the peptide. In the present invention we now provide a method of analysis of peptides which may be bound to their ligands in a reverse orientation, starting at the C terminal end and progressing to the N terminal end. This particular embodiment accounts for the situation in a peptide MHC binding relationship where the two binding partners are lying in opposite orientations to each other.

The frequent occurrence of B cell epitopes and MHC binding peptides in proximity to each other has been previously described (Bremel R D, Homan E J, 2013, Recognition of higher order patterns in proteins: immunologic kernels PLOS One. July 29;8 (7): e70115 and PCT/US2011/029192, incorporated by reference herein its entirety)). In one particular embodiment the present invention provides a means of locating a peptide sequence which comprises high affinity MHC binding peptides, by reference to an identified B cell linear epitope.

In some embodiments the present invention provides a means of identifying in a protein those specific peptide sequences which comprise a B cell binding epitope or antibody binding epitope but which are lacking in any high affinity MHC-binding peptides in the immediate proximity. In a particular embodiment this invention therefore enables the selection of peptides for inclusion in a vaccine intended to elicit an antibody response but not a cell mediated response. Conversely in yet another embodiment the invention allows the selection of peptides which will elicit a cell mediated response due to the presence of MHC binding peptides but will not elicit an antibody response due to the absence of B cell epitopes. Yet again this provides a tool for the design of vaccines in which specific categories of immune response are desired. In some specific embodiments the desired outcome may be to elicit and increased immune upregulation while in yet other embodiments the desired outcome is to increase down regulation or immunosuppression.

The present invention provides for the identification of epitopes and epitope dense regions in the proteins of *Brucella* species bacteria. In some embodiments the invention provides for the description and synthesis of a polypeptide comprising a B cell epitope and an overlapping or immediately adjacent MHC binding peptide derived from *Brucella* spp. In some particular embodiments the MHC binding peptide as and MHC I binding peptide whereas in others it is an MHC II binding peptide. In particular embodiments the aforementioned epitope peptides from *Brucella* spp bind with an affinity from the group of about greater than $10^6$ $M^{-1}$, about greater than $10^7 M^{-1}$, about greater than $10^8 M^{-1}$, and about greater than $10^9 M^{-1}$ The binding affinity may be to one or many MHC binding regions. In some particular embodiments the peptides identified as having binding affinity to B cell receptors and to MHC molecules and which are derived from *Brucella* spp are conserved across many isolates or strains of *Brucella* and said *Brucella* may be of several species including but not limited to *Brucella melitensis, Brucella abortus, Brucella suis, Brucella canis* and other species of the same genus. In particular embodiments the sequences of such peptide sequences comprising B cell epitopes and MHC binding of high affinity are provided. Other embodiments provide for the nucleic acid encoding said sequences or the said *Brucella* sequence encoded in a genetic vector, or expressed by a host cell. Having described the epitope peptides within *Brucella* the invention further describes antibodies and B cells which bid to said epitopes and various fusion products of said epitope and antibody to said epitope. By providing sequences containing the conserved epitope sequences of *Brucella* the present invention provides the constituents of a vaccine directed to protect from or to enhance recovery for brucellosis and various compositions therefor. In some embodiments the present invention provides the epitope constituents of a vaccine for human use against brucellosis; in yet other embodiments the invention provides the constituents for a vaccine for use in animals against brucellosis. It further provides the constituents of immunogens which may be used to direct the production of an antibody and to prepare a diagnostic array for detection of *Brucella* infection.

DESCRIPTION OF THE FIGURES

Figure 15:
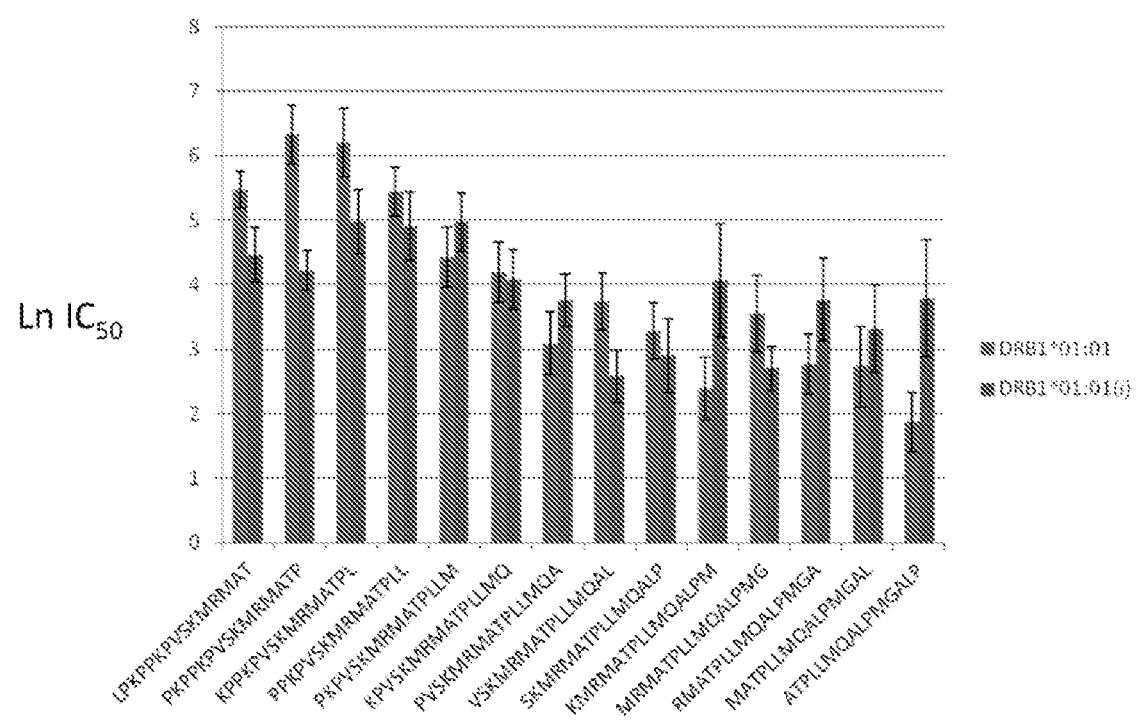

FIG. 15 shows the predicted MHC affinity for CLIP peptide in either the canonical orientation or the reverse orientation in binding groove DR1 (DRB1*01:01).

FIG. 20 shows altered flanking regions of RL9 peptide.

DEFINITIONS

Figure 1:
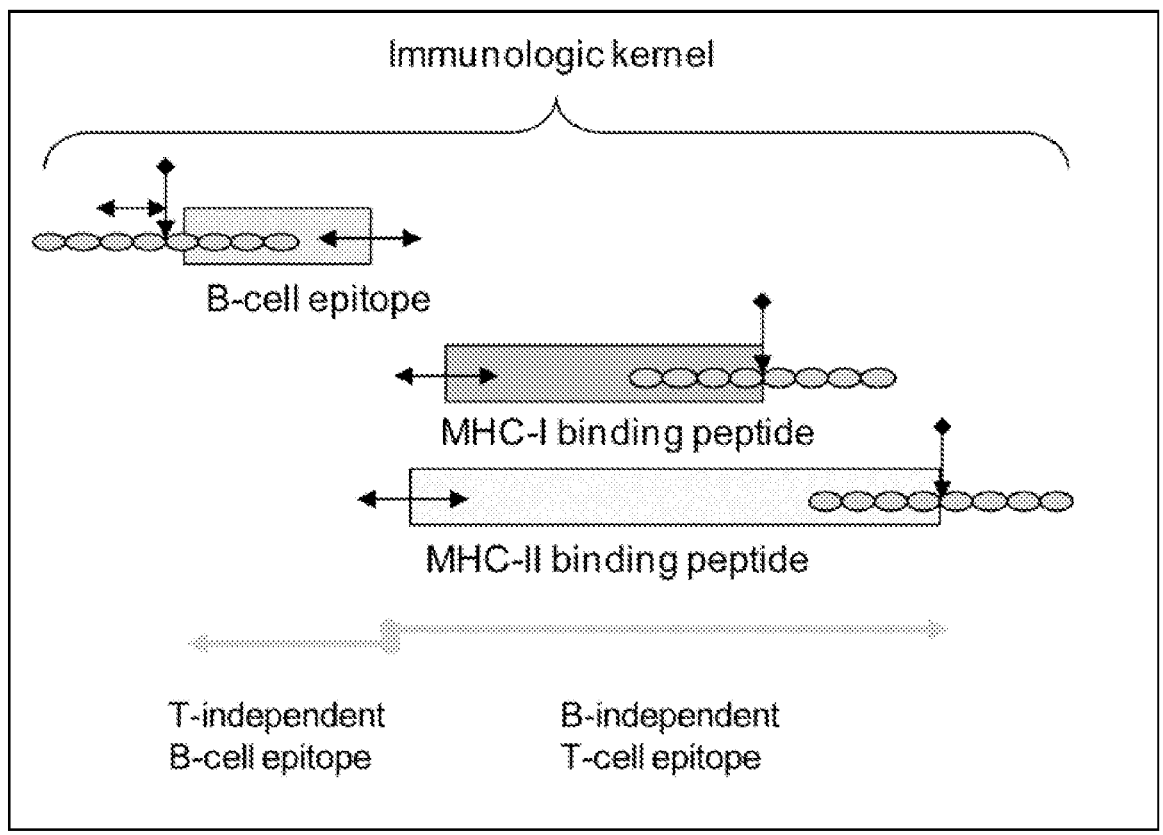
FIG. 1 shows the higher order relationship of B cell epitope, MHC binding and cathepsin cleavage as an "immunological kernel"

As used herein, the term "genome" refers to the genetic material (e.g., chromosomes) of an organism or a host cell.

As used herein, the term "proteome" refers to the entire set of proteins expressed by a genome, cell, tissue or organism. A "partial proteome" refers to a subset the entire set of proteins expressed by a genome, cell, tissue or organism. Examples of "partial proteomes" include, but are not limited to, transmembrane proteins, secreted proteins, and proteins with a membrane motif.

As used herein, the terms "protein," "polypeptide," and "peptide" refer to a molecule comprising amino acids joined via peptide bonds. In general, "peptide" is used to refer to a sequence of 20 or less amino acids and "polypeptide" is used to refer to a sequence of greater than 20 amino acids.

As used herein, the term, "synthetic polypeptide," "synthetic peptide" and "synthetic protein" refer to peptides, polypeptides, and proteins that are produced by a recombinant process (i.e., expression of exogenous nucleic acid encoding the peptide, polypeptide or protein in an organism, host cell, or cell-free system) or by chemical synthesis.

As used herein, the term "protein of interest" refers to a protein encoded by a nucleic acid of interest.

As used herein, the term "native" (or wild type) when used in reference to a protein refers to proteins encoded by the genome of a cell, tissue, or organism, other than one manipulated to produce synthetic proteins.

As used herein, the term "B-cell epitope" refers to a polypeptide sequence that is recognized and bound by a B-cell receptor. A B-cell epitope may be a linear peptide or may comprise several discontinuous sequences which together are folded to form a structural epitope. Such component sequences which together make up a B-cell epitope are referred to herein as B-cell epitope sequences. Hence, a B cell epitope may comprise one or more B-cell epitope sequences. A B cell epitope is also specifically bound by antibody produced by the same B cell.

As used herein, the term "predicted B-cell epitope" refers to a polypeptide sequence that is predicted to bind to a B-cell receptor by a computer program, for example, in addition to methods described herein, Bepipred (Larsen, et al., Immunome Research 2:2, 2006) and others as referenced by Larsen et al. (ibid) (Hopp T et al PNAS 78:3824-3828, 1981; Parker J et al, Biochem. 25:5425-5432, 1986). A predicted B-cell epitope may refer to the identification of B-cell epitope sequences forming part of a structural B-cell epitope or to a complete B-cell epitope.

As used herein, the term "T-cell epitope" refers to a polypeptide sequence bound to a major histocompatibility protein molecule in a configuration recognized by a T-cell receptor. Typically, T-cell epitopes are presented on the surface of an antigen-presenting cell.

As used herein, the term "predicted T-cell epitope" refers to a polypeptide sequence that is predicted to bind to a major histocompatibility protein molecule by the neural network (NN) algorithms described herein or as determined experimentally.

As used herein the terms "canonical" and "non-canonical" are used to refer to the orientation of an amino acid sequence. Canonical refers to an amino acid sequence presented or read in the N terminal to C terminal order; non-canonical is used to describe an amino acid sequence presented in the inverted or C terminal to N terminal order.

As used herein, the term "major histocompatibility complex (MHC)" refers to the MHC Class I and MHC Class II genes and the proteins encoded thereby. Molecules of the MHC bind small peptides and present them on the surface of cells for recognition by T-cell receptor-bearing T-cells. The MHC is both polygenic (there are several MHC class I and MHC class II genes) and polymorphic (there are multiple alleles of each gene). The terms MHC-I, MHC-II, MHC-1 and MHC-2 are variously used herein to indicate these classes of molecules. Included are both classical and non-classical MHC molecules. An MHC molecule is made up of multiple chains (alpha and beta chains) which associate to form a molecule. The MHC molecule contains a cleft which forms a binding site for peptides. Peptides bound in the cleft may then be presented to T-cell receptors. The term "MHC binding region" refers to the cleft region of the MHC molecule where peptide binding occurs.

As used herein, the term "haplotype" refers to the HLA alleles found on one chromosome and the proteins encoded thereby. Haplotype may also refer to the allele present at any one locus within the MHC. Each class of MHC is represented by several loci: e.g., HLA-A (Human Leukocyte Antigen-A), HLA-B, HLA-C, HLA-E, HLA-F, HLA-G, HLA-H, HLA-J, HLA-K, HLA-L, HLA-P and HLA-V for class I and HLA-DRA, HLA-DRB1-9, HLA-, HLA-DQA1, HLA-DQB1, HLA-DPA1, HLA-DPB1, HLA-DMA, HLA-DMB, HLA-DOA, and HLA-DOB for class II. The terms "HLA allele" and "MHC allele" are used interchangeably herein. HLA alleles are listed at hla.alleles.org/nomenclature/naming.html, which is incorporated herein by reference.

The MHCs exhibit extreme polymorphism: within the human population there are, at each genetic locus, a great number of haplotypes comprising distinct alleles—the IMGT/HLA database release (February 2010) lists 948 class I and 633 class II molecules, many of which are represented at high frequency (>1%). MHC alleles may differ by as many as 30-aa substitutions. Different polymorphic MHC alleles, of both class I and class II, have different peptide specificities: each allele encodes proteins that bind peptides exhibiting particular sequence patterns.

The naming of new HLA genes and allele sequences and their quality control is the responsibility of the WHO Nomenclature Committee for Factors of the HLA System, which first met in 1968, and laid down the criteria for successive meetings. This committee meets regularly to discuss issues of nomenclature and has published 19 major reports documenting firstly the HLA antigens and more recently the genes and alleles. The standardization of HLA antigenic specifications has been controlled by the exchange of typing reagents and cells in the International Histocompatibility Workshops. The IMGT/HLA Database collects both new and confirmatory sequences, which are then expertly analyzed and curated before been named by the Nomenclature Committee. The resulting sequences are then included in the tools and files made available from both the IMGT/HLA Database and at hla.alleles.org.

Each HLA allele name has a unique number corresponding to up to four sets of digits separated by colons. See e.g., hla.alleles.org/nomenclature/naming.html which provides a description of standard HLA nomenclature and Marsh et al., Nomenclature for Factors of the HLA System, 2010 Tissue Antigens 2010 75:291-455. HLA-DRB1*13:01 and HLA-DRB1*13:01:01:02 are examples of standard HLA nomenclature. The length of the allele designation is dependent on the sequence of the allele and that of its nearest relative. All alleles receive at least a four digit name, which corresponds to the first two sets of digits, longer names are only assigned when necessary.

The digits before the first colon describe the type, which often corresponds to the serological antigen carried by an allotype, The next set of digits are used to list the subtypes, numbers being assigned in the order in which DNA sequences have been determined. Alleles whose numbers differ in the two sets of digits must differ in one or more nucleotide substitutions that change the amino acid sequence of the encoded protein. Alleles that differ only by synonymous nucleotide substitutions (also called silent or non-coding substitutions) within the coding sequence are distinguished by the use of the third set of digits. Alleles that only differ by sequence polymorphisms in the introns or in the 5' or 3' untranslated regions that flank the exons and introns are distinguished by the use of the fourth set of digits. In addition to the unique allele number there are additional optional suffixes that may be added to an allele to indicate its expression status. Alleles that have been shown not to be expressed, 'Null' alleles have been given the suffix 'N'. Those alleles which have been shown to be alternatively expressed may have the suffix 'L', 'S', 'C', 'A' or 'Q'. The suffix 'L' is used to indicate an allele which has been shown to have 'Low' cell surface expression when compared to normal levels. The 'S' suffix is used to denote an allele specifying a protein which is expressed as a soluble 'Secreted' molecule but is not present on the cell surface. A 'C' suffix to indicate an allele product which is present in the 'Cytoplasm' but not on the cell surface. An 'A' suffix to indicate 'Aberrant' expression where there is some doubt as to whether a protein is expressed. A 'Q' suffix when the expression of an allele is 'Questionable' given that the mutation seen in the allele has previously been shown to affect normal expression levels.

In some instances, the HLA designations used herein may differ from the standard HLA nomenclature just described due to limitations in entering characters in the databases described herein. As an example, DRB1_0104, DRB1*0104, and DRB1-0104 are equivalent to the standard nomenclature of DRB1*01:04. In most instances, the asterisk is replaced with an underscore or dash and the semicolon between the two digit sets is omitted.

As used herein, the term "polypeptide sequence that binds to at least one major histocompatibility complex (MHC) binding region" refers to a polypeptide sequence that is recognized and bound by one more particular MHC binding regions as predicted by the neural network algorithms described herein or as determined experimentally.

As used herein, the term "T independent B cell epitope" means a polypeptide which comprises a B cell receptor-binding or antibody-binding peptide, but in which a high affinity MHC binding peptide is absent within 35 amino acids of the margins of said B cell binding or antibody binding peptide.

As used herein the term "B-independent T cell epitope" means a polypeptide which comprises a peptide which binds with high affinity to a MHC molecule but which has no B cell or antibody binding peptides within 35 amino acids of the margins of said MHC binding peptide.

As used herein, the term "allergen" refers to an antigenic substance capable of producing immediate hypersensitivity and includes both synthetic as well as natural immunostimulant peptides and proteins.

As used herein, the term "transmembrane protein" refers to proteins that span a biological membrane. There are two basic types of transmembrane proteins. Alpha-helical proteins are present in the inner membranes of bacterial cells or the plasma membrane of eukaryotes, and sometimes in the outer membranes. Beta-barrel proteins are found only in outer membranes of Gram-negative bacteria, cell wall of Gram-positive bacteria, and outer membranes of mitochondria and chloroplasts.

As used herein, the term "external loop portion" refers to the portion of transmembrane protein that is positioned between two membrane-spanning portions of the transmembrane protein and projects outside of the membrane of a cell.

As used herein, the term "tail portion" refers to refers to an n-terminal or c-terminal portion of a transmembrane protein that terminates in the inside ("internal tail portion") or outside ("external tail portion") of the cell membrane.

As used herein, the term "secreted protein" refers to a protein that is secreted from a cell.

As used herein, the term "membrane motif" refers to an amino acid sequence that encodes a motif not a canonical transmembrane domain but which would be expected by its function deduced in relation to other similar proteins to be located in a cell membrane, such as those listed in the publicly available psortb database.

As used herein, the term "consensus protease cleavage site" refers to an amino acid sequence that is recognized by a protease such as trypsin or pepsin.

As used herein, the term "affinity" refers to a measure of the strength of binding between two members of a binding pair, for example, an antibody and an epitope and an epitope and a MHC-I or II haplotype. $K_d$ is the dissociation constant and has units of molarity. The affinity constant is the inverse of the dissociation constant. An affinity constant is sometimes used as a generic term to describe this chemical entity. It is a direct measure of the energy of binding. The natural logarithm of K is linearly related to the Gibbs free energy of binding through the equation $\Delta G_0 = -RT\ LN(K)$ where R=gas constant and temperature is in degrees Kelvin. Affinity may be determined experimentally, for example by surface plasmon resonance (SPR) using commercially available Biacore SPR units (GE Healthcare) or in silico by methods such as those described herein in detail.

Affinity may also be expressed as the ic50 or inhibitory concentration 50, that concentration at which 50% of the peptide is displaced. Likewise ln(ic50) refers to the natural log of the ic50.

The term "$K_{off}$", as used herein, is intended to refer to the off rate constant, for example, for dissociation of an antibody from the antibody/antigen complex, or for dissociation of an epitope from an MHC haplotype.

The term "$K_d$", as used herein, is intended to refer to the dissociation constant (the reciprocal of the affinity constant "Ka"), for example, for a particular antibody-antigen interaction or interaction between an epitope and an MHC haplotype.

As used herein, the terms "strong binder" and "strong binding" refer to a binding pair or describe a binding pair that have an affinity of greater than $2 \times 10^7 M^{-1}$ (equivalent to a dissociation constant of 50 nM Kd)

As used herein, the term "moderate binder" and "moderate binding" refer to a binding pair or describe a binding pair that have an affinity of from $2 \times 10^7 M^{-1}$ to $2 \times 10^6 M^{-1}$.

As used herein, the terms "weak binder" and "weak binding" refer to a binding pair or describe a binding pair that have an affinity of less than $2 \times 10^6 M^{-1}$ (equivalent to a dissociation constant of 500 nM Kd)

The terms "specific binding" or "specifically binding" when used in reference to the interaction of an antibody and a protein or peptide or an epitope and an MHC haplotype means that the interaction is dependent upon the presence of a particular structure (i.e., the antigenic determinant or epitope) on the protein; in other words the antibody is recognizing and binding to a specific protein structure rather than to proteins in general. For example, if an antibody is specific for epitope "A," the presence of a protein containing epitope A (or free, unlabelled A) in a reaction containing labeled "A" and the antibody will reduce the amount of labeled A bound to the antibody.

As used herein, the term "antigen binding protein" refers to proteins that bind to a specific antigen. "Antigen binding proteins" include, but are not limited to, immunoglobulins, including polyclonal, monoclonal, chimeric, single chain, and humanized antibodies, Fab fragments, F(ab')2 fragments, and Fab expression libraries. Various procedures known in the art are used for the production of polyclonal antibodies. For the production of antibody, various host animals can be immunized by injection with the peptide corresponding to the desired epitope including but not limited to rabbits, mice, rats, sheep, goats, etc. Various adjuvants are used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (Bacille Calmette-Guerin) and *Corynebacterium parvum*.

For preparation of monoclonal antibodies, any technique that provides for the production of antibody molecules by continuous cell lines in culture may be used (See e.g., Harlow and Lane, Antibodies: A Laboratory Manual, Cold Spring Harbor Laboratory Press, Cold Spring Harbor, N.Y.). These include, but are not limited to, the hybridoma technique originally developed by Köhler and Milstein (Köhler and Milstein, Nature, 256:495-497 [1975]), as well as the trioma technique, the human B-cell hybridoma technique (See e.g., Kozbor et al., Immunol. Today, 4:72 [1983]), and the EBV-hybridoma technique to produce human monoclonal antibodies (Cole et al., in Monoclonal Antibodies and Cancer Therapy, Alan R. Liss, Inc., pp. 77-96 [1985]). In other embodiments, suitable monoclonal antibodies, including recombinant chimeric monoclonal antibodies and chimeric monoclonal antibody fusion proteins are prepared as described herein.

According to the invention, techniques described for the production of single chain antibodies (U.S. Pat. No. 4,946,778; herein incorporated by reference) can be adapted to produce specific single chain antibodies as desired. An additional embodiment of the invention utilizes the techniques known in the art for the construction of Fab expression libraries (Huse et al., Science, 246:1275-1281 [1989]) to allow rapid and easy identification of monoclonal Fab fragments with the desired specificity.

Antibody fragments that contain the idiotype (antigen binding region) of the antibody molecule can be generated by known techniques. For example, such fragments include but are not limited to: the F(ab')2 fragment that can be produced by pepsin digestion of an antibody molecule; the Fab' fragments that can be generated by reducing the disulfide bridges of an F(ab')2 fragment, and the Fab fragments that can be generated by treating an antibody molecule with papain and a reducing agent.

Genes encoding antigen-binding proteins can be isolated by methods known in the art. In the production of antibodies, screening for the desired antibody can be accomplished by techniques known in the art (e.g., radioimmunoassay, ELISA (enzyme-linked immunosorbant assay), "sandwich" immunoassays, immunoradiometric assays, gel diffusion precipitin reactions, immunodiffusion assays, in situ immunoassays (using colloidal gold, enzyme or radioisotope labels, for example), Western Blots, precipitation reactions, agglutination assays (e.g., gel agglutination assays, hemagglutination assays, etc.), complement fixation assays, immunofluorescence assays, protein A assays, and immunoelectrophoresis assays, etc.) etc.

As used herein, the terms "computer memory" and "computer memory device" refer to any storage media readable by a computer processor. Examples of computer memory include, but are not limited to, RAM, ROM, computer chips, digital video disc (DVDs), compact discs (CDs), hard disk drives (HDD), and magnetic tape.

As used herein, the term "computer readable medium" refers to any device or system for storing and providing information (e.g., data and instructions) to a computer processor. Examples of computer readable media include, but are not limited to, DVDs, CDs, hard disk drives, magnetic tape and servers for streaming media over networks.

As used herein, the terms "processor" and "central processing unit" or "CPU" are used interchangeably and refer to a device that is able to read a program from a computer memory (e.g., ROM or other computer memory) and perform a set of steps according to the program.

As used herein, the term "support vector machine" refers to a set of related supervised learning methods used for classification and regression. Given a set of training examples, each marked as belonging to one of two categories, an SVM training algorithm builds a model that predicts whether a new example falls into one category or the other.

As used herein, the term "classifier" when used in relation to statistical processes refers to processes such as neural nets and support vector machines.

As used herein "neural net", which is used interchangeably with "neural network" and sometimes abbreviated as NN, refers to various configurations of classifiers used in machine learning, including multilayered perceptrons with one or more hidden layer, support vector machines and dynamic Bayesian networks. These methods share in common the ability to be trained, the quality of their training evaluated and their ability to make either categorical classifications or of continuous numbers in a regression mode.

Perceptron as used herein is a classifier which maps its input x to an output value which is a function of x, or a graphical representation thereof.

As used herein "recursive partitioning" or "recursive partitioning algorithm" refers to a statistical method for multivariable analysis. Recursive partitioning operates through a decision tree that strives to correctly classify members of the population based on several dichotomous dependent variables.

As used herein, the term "principal component analysis" refers to a mathematical process which reduces the dimensionality of a set of data (Wold, S., Sjorstrom, M., and Eriksson, L., Chemometrics and Intelligent Laboratory Systems 2001. 58: 109-130; Multivariate and Megavariate Data Analysis Basic Principles and Applications (Parts I&II) by L. Eriksson, E. Johansson, N. Kettaneh-Wold, and J. Trygg, 2006 $2^{nd}$ Edit. Umetrics Academy). Derivation of principal components is a linear transformation that locates directions of maximum variance in the original input data, and rotates the data along these axes. For n original variables, n principal components are formed as follows: The first principal component is the linear combination of the standardized original variables that has the greatest possible variance. Each subsequent principal component is the linear combination of the standardized original variables that has the greatest possible variance and is uncorrelated with all previously defined components. Further, the principal components are scale-independent in that they can be developed from different types of measurements.

As used herein, the term "vector" when used in relation to a computer algorithm or the present invention, refers to the mathematical properties of the amino acid sequence.

As used herein, the term "vector," when used in relation to recombinant DNA technology, refers to any genetic element, such as a plasmid, phage, transposon, cosmid, chromosome, retrovirus, virion, etc., which is capable of replication when associated with the proper control elements and which can transfer gene sequences between cells. Thus, the term includes cloning and expression vehicles, as well as viral vectors.

As used herein, the terms "biocide" or "biocides" refer to at least a portion of a naturally occurring or synthetic molecule (e.g., peptides or enzymes) that directly kills or promotes the death and/or attenuation of (e.g., prevents growth and/or replication) of biological targets (e.g., bacteria, parasites, yeast, viruses, fungi, protozoas and the like). Examples of biocides include, but are not limited to, bactericides, viricides, fungicides, parasiticides, and the like.

As used herein, the terms "protein biocide" and "protein biocides" refer to at least a portion of a naturally occurring or synthetic peptide molecule or enzyme that directly kills or promotes the death and/or attenuation of (e.g., prevents growth and/or replication) of biological targets (e.g., bacteria, parasites, yeast, viruses, fungi, protozoas and the like). Examples of biocides include, but are not limited to, bactericides, viricides, fungicides, parasiticides, and the like.

As used herein, the term "neutralization," "pathogen neutralization," "and spoilage organism neutralization" refer to destruction or inactivation (e.g., loss of virulence) of a "pathogen" or "spoilage organism" (e.g., bacterium, parasite, virus, fungus, mold, prion, and the like) thus preventing the pathogen's or spoilage organism's ability to initiate a disease state in a subject or cause degradation of a food product.

As used herein, the term "spoilage organism" refers to microorganisms (e.g., bacteria or fungi), which cause degradation of the nutritional or organoleptic quality of food and reduces its economic value and shelf life. Exemplary food spoilage microorganisms include, but are not limited to, *Zygosaccharomyces bailii, Aspergillus niger, Saccharomyces cerivisiae, Lactobacillus plantarum, Streptococcus faecalis,* and *Leuconostoc mesenteroides.*

As used herein, the term "microorganism targeting molecule" refers to any molecule (e.g., protein) that interacts with a microorganism. In preferred embodiments, the microorganism targeting molecule specifically interacts with microorganisms at the exclusion of non-microorganism host cells. Preferred microorganism targeting molecules interact with broad classes of microorganism (e.g., all bacteria or all gram positive or negative bacteria). However, the present invention also contemplates microorganism targeting molecules that interact with a specific species or sub-species of microorganism. In some preferred embodiments, microorganism targeting molecules interact with "Pathogen Associated Molecular Patterns (PAMPS)". In some embodiments, microorganism targeting molecules are recognition molecules that are known to interact with or bind to PAMPS (e.g., including, but not limited to, as CD14, lipopolysaccharide binding protein (LBP), surfactant protein D (SP-D), and Mannan binding lectin (MBL)). In other embodiments, microorganism targeting molecules are antibodies (e.g., monoclonal antibodies directed towards PAMPS or monoclonal antibodies directed to specific organisms or serotype specific epitopes).

As used herein the term "biofilm" refers to an aggregation of microorganisms (e.g., bacteria) surrounded by an extracellular matrix or slime adherent on a surface in vivo or ex vivo, wherein the microorganisms adopt altered metabolic states.

As used herein, the term "host cell" refers to any eukaryotic cell (e.g., mammalian cells, avian cells, amphibian cells, plant cells, fish cells, insect cells, yeast cells), and bacteria cells, and the like, whether located in vitro or in vivo (e.g., in a transgenic organism).

As used herein, the term "cell culture" refers to any in vitro culture of cells. Included within this term are continuous cell lines (e.g., with an immortal phenotype), primary cell cultures, finite cell lines (e.g., non-transformed cells), and any other cell population maintained in vitro, including oocytes and embryos.

The term "isolated" when used in relation to a nucleic acid, as in "an isolated oligonucleotide" refers to a nucleic acid sequence that is identified and separated from at least one contaminant nucleic acid with which it is ordinarily associated in its natural source. Isolated nucleic acids are nucleic acids present in a form or setting that is different from that in which they are found in nature. In contrast, non-isolated nucleic acids are nucleic acids such as DNA and RNA that are found in the state in which they exist in nature.

The terms "in operable combination," "in operable order," and "operably linked" as used herein refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced.

A "subject" is an animal such as vertebrate, preferably a mammal such as a human, a bird, or a fish. Mammals are understood to include, but are not limited to, murines, simians, humans, bovines, cervids, equines, porcines, canines, felines etc.).

An "effective amount" is an amount sufficient to effect beneficial or desired results. An effective amount can be administered in one or more administrations, As used herein, the term "purified" or "to purify" refers to the removal of undesired components from a sample. As used herein, the term "substantially purified" refers to molecules, either nucleic or amino acid sequences, that are removed from their natural environment, isolated or separated, and are at least 60% free, preferably 75% free, and most preferably 90% free from other components with which they are naturally associated. An "isolated polynucleotide" is therefore a substantially purified polynucleotide.

The terms "bacteria" and "bacterium" refer to prokaryotic organisms, including those within all of the phyla in the Kingdom Procaryotae. It is intended that the term encompass all microorganisms considered to be bacteria including *Mycoplasma, Chlamydia, Actinomyces, Streptomyces*, and *Rickettsia*. All forms of bacteria are included within this definition including cocci, bacilli, spirochetes, spheroplasts, protoplasts, etc. Also included within this term are prokaryotic organisms that are gram negative or gram positive. "Gram negative" and "gram positive" refer to staining patterns with the Gram-staining process that is well known in the art. (See e.g., Finegold and Martin, Diagnostic Microbiology, 6th Ed., CV Mosby St. Louis, pp. 13-15 [1982]). "Gram positive bacteria" are bacteria that retain the primary dye used in the Gram stain, causing the stained cells to appear dark blue to purple under the microscope. "Gram negative bacteria" do not retain the primary dye used in the Gram stain, but are stained by the counterstain. Thus, gram negative bacteria appear red. In some embodiments, the bacteria are those capable of causing disease (pathogens) and those that cause product degradation or spoilage.

"Strain" as used herein in reference to a microorganism describes an isolate of a microorganism (e.g., bacteria, virus, fungus, parasite) considered to be of the same species but with a unique genome and, if nucleotide changes are non-synonymous, a unique proteome differing from other strains of the same organism. Typically strains may be the result of isolation from a different host or at a different location and time but multiple strains of the same organism may be isolated from the same host.

"Anergy" as used herein refers to a lack of reaction by the body's immune system to foreign substances. In some embodiments, anergy comprises a direct induction of peripheral lymphocyte tolerance. In some embodiments, an individual in a state of anergy is unable to mount a normal immune response against a specific antigen.

As used herein "regulatory T cells" refers to a subpopulation of T cells which are immunosuppressive and down-regulate the immune system. T regulatory cells may function to maintain tolerance to self-antigens, and downregulate autoimmune disease. Regulatory T cells may be abbreviated herein as $T_{reg}$, or Treg.

As used herein "orthogonal" refers to a parameter or a mathematical expression which is statistically independent from another such parameter or mathematical expression. Hence orthogonal and uncorrelated are used interchangeably herein.

As used herein "bagging" which is an abbreviated term for "bootstrap aggregation" is used to describe a process whereby small, balanced subsets of data are selected randomly from a larger training dataset and processed, followed by processing of a further randomly selected subset of data from the same dataset. This cycle is repeated multiple times with different random subsets from the same dataset. This process is used for training and validation of the classifiers, then allowing the resulting predictors to be applied to larger datasets. For instance 5 k-fold cross validation may be performed 5 times, each time starting with a different seed for the random number generator.

As used herein "ensemble" is used to describe a collection of similar equations or computer processes each contributing to an overall analysis. In some instances an ensemble may be a series of predictive equations each focused on a prediction specific to a particular circumstance. Ensembles may be used as a form of analysis as a "committee" where a determination is based on the "vote" of each member of the ensemble. Thus if 8 of 10 equations predict outcome "A" and 2 of 10 predict outcome "not A" then a prediction of 0.8 probability of A is made As used herein the term "training set" refers to a database or large set of peptides for which experimental determinations of certain properties have been reported. Such properties may include but not be limited to binding affinity to ligands of interest such as MHC molecules, enzyme cleavage properties or any other such properties which may be measured in an experimental assay. A training set then is used as an input in developing predictions through a machine learning tool which may include a neural net or support vector machine among many non-limiting examples.

DETAILED DESCRIPTION OF THE INVENTION

The present invention describes specific novel applications of the mathematical analysis of binding which allow manipulation of the binding affinity to increase or decrease the antigenicity of a specific epitope. It further describes approaches to selection of epitopes with specific types of binding interaction. In yet further embodiments, the present invention describes application of binding analysis to *Brucella* species to identify epitopes with specific biding characteristics.

This invention further relates to the identification of peptide epitopes from proteomes of microorganisms and host cells. Such epitopes upon interacting with the immune system may elicit an upregulation or down regulation of the immune response. Once peptide epitopes are identified, they can be synthesized or produced as recombinant products (e.g., the epitope itself or a polypeptide or protein comprising the epitope) and utilized in vaccines, diagnostics or as targets of drug therapy. The accurate prediction of peptides which are epitopes for either B-cell or T-cell mediated immunity is thus an important step in providing, among other things: understanding of how the proteome is presented to, and processed by, the immune system; information enabling development of improved vaccines, biotherapeutics, diagnostics, and antimicrobial drugs; and methods of identifying targets on membrane proteins potentially useful to other areas of research. A computer implemented process for analysis of peptide binding and epitope identification has been previously described by the inventors (see, e.g., PCT/US2011/029192, incorporated by reference herein its entirety) but for reference is summarized below. The present invention addresses specific novel embodiments and applications of peptide epitope analysis.

Overview of Computer Implemented Process for Analysis of Peptide Binding

The field of bioinformatics has provided powerful tools to analyze large datasets arising from sequenced genomes, proteomes and transcriptomes. But often analysis of the proteomic information has been based on individual amino acids, using sequences, not segments, and without translation to structure, biological function and location of the proteins in the whole organism. The leading proponents of reverse vaccinology identify the challenge of the future as the integration of sequence-based prediction with structural information (Serruto and Rappuoli. 2006. FEBS Lett. 580: 2985-2992.)

For the reasons stated above there is a need for a method to identify peptide epitopes for both B and T-cell immunity which can enhance the development of vaccines, therapeutics and vaccines. The present invention provides methods of B-cell epitope prediction and MHC binding region prediction, together with the topological/protein structural considerations. It also provides an integrated approach and enables the management of peptide epitope analysis from a desktop computer in a familiar spreadsheet format.

Accordingly, in some embodiments, the present invention provides computer implemented processes of identifying ligands (e.g., peptides) that interact with a partner or substrate, e.g., other polypeptides, including but not limited to, B-cell receptors and antibodies, MHC-I and II binding regions, protein receptors, polypeptide domains such as binding domains and catalytic domains, organic molecules, aptamers, nucleic acids and the like. In some embodiments, the present invention provides computer implemented processes of describing peptides that interact with a partner or substrate by formulation of a mathematical expression that correlates to or applies one or more physical properties of amino acid within an amino acid subset and applies the mathematical expression to predict the interaction (e.g., binding) of the amino acids subset with the partner. In some embodiments, the present invention provides computer implemented processes of identifying peptides that interact with a partner or substrate that formulate a mathematical expression that correlates to or describes one or more physical properties of amino acids within an amino acid subset, substitutes the amino acids with the mathematical expression, and applies the mathematical expression to predict the interaction (e.g., binding) of the amino acid subset with the partner. In some embodiments, the present invention provides computer implemented processes of identifying peptides that interact with a partner or substrate that formulate a mathematical expression based on the principal components of physical properties of amino acids within an amino acid subset and applies the mathematical expression to predict the interaction (e.g., binding) of the amino acids subset with the partner. In some embodiments, the present invention provides computer implemented processes of identifying peptides that interact with a partner or substrate that formulate a mathematical expression based on the principal components of physical properties of amino acids within an amino acid subset and applies the mathematical expression to predict the interaction (e.g., binding) of the amino acids subset with the partner. In some embodiments, the present invention provides computer implemented processes of identifying peptides that interact with a partner or substrate that formulate a mathematical expression based on the principal components of physical properties of amino acids within an amino acid subset and applies the mathematical expression to predict the interaction (e.g., binding) of the amino acids subset with the partner using a trained neural network. In some embodiments, the present invention provides computer implemented processes of identifying peptides that interact with MHC binding region, B cell receptor, or antibody that formulate a mathematical expression based on the principal components of physical properties of amino acids within an amino acid subset and applies the mathematical expression to predict the interaction (e.g., binding) of the amino acids subset with the partner using a trained neural network, for example a neural network trained for peptide binding to one more MHC alleles or binding regions.

In some embodiments, the present invention comprises a computer implemented process comprising: in-putting an amino acid sequence from a target source into a computer; analyzing more than one physical parameter of subsets of amino acids in the sequence via a computer processor; deriving a mathematical expression to describe amino acid subsets. The descriptors of amino acid subsets, or peptides, are then compared with the experimentally determined binding reactions of a large set of peptides, known as a training set. In some embodiments the comparison is conducted through the application of least squares regression. In some embodiments this analysis is achieved through the application of a neural network. In yet other embodiments other machine learning tools may be applied, such as but not limited to, a support vector machine. Through this process a series of predictive equations are developed which may be applied to any peptide from any protein of interest, once said peptide is converted to a mathematical descriptor based on its physical parameters. The physicochemical properties derived in the studies used for this calculation are shown in Table

TABLE 1

| | | |
|---|---|---|
| 1 | Polarity. | Zimmerman, J. M., Eliezer, N., and Simha, R., J.Theor.Biol. 1968. 21: 170-201. |
| 2 | Polarity (p). | Grantham, R., Science 1974. 185: 862-864. |
| 3 | Optimized matching hydrophobicity (OMH). | Sweet, R. M. and Eisenberg, D., J.Mol.Biol. 1983. 171: 479-488. |
| 4 | Hydropathicity. | Kyte, J. and Doolittle, R. F.,. J.Mol.Biol. 1982. 157: 105-132. |
| 5 | Hydrophobicity (free energy of transfer to surface in kcal/mole). | Bull, H. B. and Breese, K., Arch.Biochem.Biophys. 1974. 161: 665-670. |
| 6 | Hydrophobicity scale based on free energy of transfer (kcal/mole). | Guy, H. R., Biophys.J. 1985. 47: 61-70. |
| 7 | Hydrophobicity (delta G1/2 cal) | Abraham, D. J. and Leo, A. J., Proteins 1987. 2: 130-152. |
| 8 | Hydrophobicity scale (contact energy derived from 3D data). | Miyazawa, S. and Jernigan, R. L., Macromolecules 1985. 18: 534-552. |
| 9 | Hydrophobicity scale (pi-r). | Roseman, M. A., J.Mol.Biol. 1988. 200: 513-522. |
| 10 | Molar fraction (%) of 2001 buried residues. | Janin, J., Nature 1979. 277: 491-492. |
| 11 | Proportion of residues 95% buried (in 12 proteins). | Chothia, C., J.Mol.Biol. 1976. 105: 1-12. |
| 12 | Free energy of transfer from inside to outside of a globular protein. | Janin, J., Nature 1979. 277: 491-492. |
| 13 | Hydration potential (kcal/mole) at 25C. | Wolfenden, R., Andersson, L., Cullis, P. M., and Southgate, C. C., Biochemistry 1981. 20: 849-855. |
| 14 | Membrane buried helix parameter. | Rao, M. J. K. and Argos, P., Biochim.Biophys.Acta 1986. 869: 197-214. |
| 15 | Mean fractional area loss (f) [average area buried/ standard state area]. | Rose, G. D., Geselowitz, A. R., Lesser, G. J., Lee, R. H., and Zehfus, M. H., Science 1985. 229: 834-838. |
| 16 | Average area buried on transfer from standard state to folded protein. | Rose, G. D., Geselowitz, A. R., Lesser, G. J., Lee, R. H., and Zehfus, M. H., Science 1985. 229: 834-838. |
| 17 | Molar fraction (%) of 3220 accessible residues. | Janin, J., Nature 1979. 277: 491-492. |
| 18 | Hydrophilicity. | Hopp, T. P., Methods Enzymol. 1989. 178: 571-585. |

TABLE 1-continued

| | | |
|---|---|---|
| 19 | Normalized consensus hydrophobicity scale. | Eisenberg, D., Schwarz, E., Komaromy, M., and Wall, R., J.Mol.Biol. 1984. 179: 125-142. |
| 20 | Average surrounding hydrophobicity. | Manavalan, P. and Ponnuswamy, P. K., Nature 1978. 275: 673-674. |
| 21 | Hydrophobicity of physiological L-alpha amino acids | Black, S. D. and Mould, D. R., Anal.Biochem. 1991. 193: 72-82 |
| 22 | Hydrophobicity scale (pi-r)2. | Fauchere, J. L., Charton, M., Kier, L. B., Verloop, A., and Pliska, V., Int.J.Pept.Protein Res. 1988. 32: 269-278. |
| 23 | Retention coefficient in HFBA. | Browne, C. A., Bennett, H. P., and Solomon, S., Anal.Biochem. 1982. 124: 201-208. |
| 24 | Retention coefficient in HPLC, pH 2.1. | Meek, J. L., Proc.Natl.Acad.Sci.U.S.A 1980. 77: 1632-1636. |
| 25 | Hydrophilicity scale derived from HPLC peptide retention times. | Parker, J. M., Guo, D., and Hodges, R. S., Biochemistry 1986. 25: 5425-5432. |
| 26 | Hydrophobicity indices at ph 7.5 determined by HPLC. | Cowan, R. and Whittaker, R. G., Pept.Res. 1990. 3: 75-80. |
| 27 | Retention coefficient in TFA | Browne, C. A., Bennett, H. P., and Solomon, S., Anal.Biochem. 1982. 124: 201-208. |
| 28 | Retention coefficient in HPLC, pH 7.4 | Meek, J. L., Proc.Natl.Acad.Sci.U.S.A 1980. 77: 1632-1636. |
| 29 | Hydrophobicity indices at pH 3.4 determined by HPLC | Cowan, R. and Whittaker, R. G., Pept.Res. 1990. 3: 75-80. |
| 30 | Mobilities of amino acids on chromatography paper (RF) | Akintola, A. and Aboderin, A. A., Int.J.Biochem. 1971. 2: 537-544. |
| 31 | Hydrophobic constants derived from HPLC peptide retention times | Wilson, K. J., Honegger, A., Stotzel, R. P., and Hughes, G. J., Biochem.J. 1981. 199: 31-41. |

In some preferred embodiments, amino acid physical property principal components are used as the inputs to build mathematical descriptors of peptides. A particular advantage of principal component analysis is that the weighting and ranking of the principal components reflect the contribution of each to the underlying variance. Principal components thus provide uncorrelated or orthogonal proxies which are weighted and ranked.

Briefly, for MHC-II a protein is broken down into 15-mer peptides each offset by 1 amino acid. The peptide 15-mers are converted into vectors of principal components wherein each amino acid in a 15-mer is replaced by three z-scale descriptors. $\{z1(aa1),z2(aa1),z3(aa1)\}$, $\{z1(aa2),z2(aa2),z3(aa2)\}$, $\{z1(aa15),z2(aa15),z3(aa15)\}$ that are effectively physical property proxy variables. With these descriptors ensembles of neural network prediction equation sets are developed, using publicly available datasets of peptide-MHC binding data, wherein the inhibitory concentration 50% ($ic_{50}$) has been catalogued as a measure of binding affinity of the peptides for a number of different HLAs. Because the $ic_{50}$ data have a numerical range in excess of 10,000-fold they are natural logarithm transformed to give the data better distributional properties for predictions and subsequent statistical analysis used the $\ln(ic_{50})$. For each of the 15-mers predicted $\ln(ic_{50})$ values are computed for fourteen different human DRB class MHC-II alleles DRB1*0101, DRB1*0301, DRB1*0401, DRB1*0404, DRB1*0405, DRB1*0701, DRB1*0802, DRB1*0901, DRB1*1101, DRB1*1302, DRB1*1501, DRB3*0101, DRB4*0101, DRB5*0101, or, for example, human DPQ class and human DQB alleles. The peptide data is indexed to the N-terminal amino acid and thus each prediction corresponds to the 15-amino acid peptide downstream from the index position. See, e.g., An integrated approach to epitope analysis I: Dimensional reduction, visualization and prediction of MHC binding using amino acid principal components and regression approaches. Bremel R D, Homan E J. Immunome Res. 2010 Nov. 2; 6:7; An integrated approach to epitope analysis II: A system for proteomic-scale prediction of immunological characteristics. Bremel R D, Homan E J. Immunome Res. 2010 Nov. 2; 6:8.

An identical process is then followed with all 9-mer peptides for prediction of binding to 35 MHC-I alleles: A*0101, A*0201, A*0202, A*0203, A*0206, A*0301, A*1101, A*2301, A*2402, A*2403, A*2601, A*2902, A*3001, A*3002, A*3101, A*3301, A*6801, A*6802, A*6901, B*0702, B*0801, B*1501, B*1801, B*2705, B*3501, B*4001, B*4002, B*4402, B*4403, B*4501, B*5101, B*5301, B*5401, B*5701, B*5801. Each of the alleles has a different characteristic mean and standard deviation of binding affinity. Thus, for statistical comparisons involving multiple HLA alleles the predicted $\ln(ic_{50})$ values are standardized to zero mean and unit standard deviation on a within-protein basis. The same process has been repeated with murine alleles and may be applied to the MHC molecules of any other species for which there are training sets available. It may further applied to any additional human alleles for which training sets become available.

The current invention provides a novel extension of statistical work of Wold and his colleagues who introduced the concept of amino acid principal components of small peptides in a predictive way with a partial least squares (PLS) regression process. See, e.g., Sjostrom M, Eriksson L, Hellberg S, Jonsson J, Skagerberg B, et al. (1989) Peptide QSARS: PLS modelling and design in principal properties, Prog Clin Biol Res 291: 313-317; Hellberg S, Sjostrom M, Skagerberg B, Wold S (1987) Peptide quantitative structure-activity relationships, a multivariate approach. J Med Chem 30: 1126-1135; Linusson A, Elofsson M, Andersson I E, Dahlgren M K (2010) Statistical molecular design of balanced compound libraries for QSAR modeling. Curr Med Chem 17: 2001-2016; Linusson A, Gottfries J, Lindgren F, Wold S (2000) Statistical molecular design of building blocks for combinatorial chemistry. J Med Chem 43: 1320-1328.

The methodology elaborated herein enables the description of binding of an amino acid subset or peptide derived from a protein to a binding partner, based on the use of principal components as proxies for the salient physical parameters of the peptide. Having used the principal components to reduce the dimensionality of the descriptors to a mathematical expression, it is then possible to analyze the binding interface of the peptide by statistical comparison to the binding of training sets of peptides to MHC molecules. In applications described herein, this technology is applied to understanding the binding to binding partners derived from the humoral and cellular immune system (B cell receptors or antibodies and MHC molecules which present peptides to T-cell epitopes). This however should not be considered limiting and the methodology may also be applied to other peptide binding and recognition events. Examples of such events include but are not limited to enzyme recognition of peptides, receptor binding of peptides (including but not limited to sensory receptors such as olfactory or taste receptors, receptors which bind to protein hormones, viral receptors on cell surfaces etc). Indeed the approach of using principal components to describe a peptide interface with a binding partner is applicable whether said binding partner is another protein or a lipid, carbohydrate or other substrate.

The detailed processes of the computer assisted methods are described in PCT/US2011/029192, incorporated by reference herein its entirety. The present invention addresses specific applications of the processes.

Modification of Binding Affinity

Once an epitope has been identified by the computer implemented process outlined above and as further described in PCT/US2011/029192, the present invention provides means to design a synthetic epitope wherein the binding affinity of such a peptide epitope to a MHC molecule is increased or decreased relative to the native peptide. Therefore the present invention provides an approach to design an MHC binding peptide with increased or reduced binding affinity. By changing the duration of binding, or dwell time of the peptide in a MHC molecular groove the outcome of the immune stimulation which results from said pMHC engaging a T cell receptor can be changed. In some embodiments the change in binding affinity may result in an increase in T helper and cytotoxic T cell responses and the amplification of an immune response. In yet other embodiments the change in binding affinity may result in an immunosuppressive response. The present invention provides the means to bring about such immunomodulation. In yet other embodiments the present invention enables changes in the epitope peptide which change the amino acid motif exposed to T cell recognition and thus may result in stimulation of a different T cell population. In some embodiments this may have the goal of increasing or reducing the immune response or on yet other embodiments of guiding the immune response along a particular clonal expansions pathway.

The alteration in binding affinity can be accomplished by making one or more amino acid changes in the peptide. The present invention allows the simulation of the effect on predicted binding affinity resulting from many possible amino acid changes and hence the selection of those changes which bring about the desired change through increase or reduction of binding.

In yet other instances such changes may be effected to change the amino acids exposed to the T cells, in other embodiments such changes may be effected to change the binding to the MHC molecular groove. As binding is specific to each allele of MHC the change in amino acids produces an increase or decrease in binding specific to a particular MHC allele. In some embodiments amino acid changes may be made to effect a change in binding to 1, or 2, or 3 or up to 5 or more MHC alleles simultaneously.

The present invention provides approaches for increasing and decreasing MHC binding by adjustment of amino acids in an MHC binding peptide. Such peptides may be from epitopes derived from infectious organisms including, but not limited to, viruses, bacteria, fungi, rickettsia, helminthes and other pathogens and parasites. Examples of the infectious organisms which may be analyzed and from which peptides may be identified as epitopes and subjected to modification as described herein to change the binding to MHC molecules are the following:

*Francisella* spp., *Bartonella* spp., *Borrelia* spp., *Campylobacter* spp., *Chlamydia* spp., *Simkania* spp., *Escherichia* spp. *Ehrlichia* spp. *Clostridium* spp., *Enterococcus* spp., *Haemophilius* spp., *Coccidioides* spp., *Bordetella* spp., *Coxiella* spp., *Ureaplasma* spp., *Mycoplasma* spp., *Trichomatis* spp., *Helicobacter* spp., *Legionella* spp., *Mycobacterium* spp., *Corynebacterium* spp., *Rhodococcus* spp., *Rickettsia* spp., *Arcanobacterium* spp., *Bacillus* spp., *Listeria* spp., *Yersinia* spp., *Shigella* spp., *Neisseria* spp., *Streptococcus* spp., *Staphylococcus* spp., *Vibrio* spp., *Salmonella* spp., *Treponema* spp., *Brucella* spp., *Campylobacter* spp., *Shigella* spp., *Mycoplasma* spp., *Pasteurella* spp., *Pseudomonas* ssp., and *Burkholderii* spp, Human and porcine rhinovirus, Human coronavirus, Dengue virus, Filoviruses (e.g., Marburg and Ebola viruses), Hantavirus, Rift Valley virus, Hepatitis B, C, and E, Human Immunodeficiency Virus (e.g., HIV-1, HIV-2), HHV-8, Human papillomavirus, Herpes virus (e.g., HV-I and HV-II), Human T-cell lymphotrophic viruses (e.g., HTLV-I and HTLV-II), Bovine leukemia virus, Influenza virus, Guanarito virus, Lassa virus, Measles virus, Rubella virus, Mumps virus, Chickenpox (Varicella virus), Monkey pox, Epstein Bahr virus, Norwalk (and Norwalk-like) viruses, Rotavirus, Parvovirus B19, Hantaan virus, Sin Nombre virus, Venezuelan equine encephalitis, Sabia virus, West Nile virus, Yellow Fever virus, causative agents of transmissible spongiform encephalopathies, Creutzfeldt-Jakob disease agent, variant Creutzfeldt-Jakob disease agent, *Candida, Cryptcooccus, Cryptosporidium, Giardia lamblia, Microsporidia, Plasmodium vivax, Pneumocystis carinii, Toxoplasma gondii, Trichophyton mentagrophytes, Enterocytozoon bieneusi, Cyclospora cayetanensis, Encephalitozoon hellem, Encephalitozoon cuniculi, Ancylostama, Strongylus, Trichostrongylus, Haemonchus, Ostertagia, Ascaris, Toxascaris, Uncinaria, Trichuris, Dirofilaria, Toxocara, Necator, Enterobius, Strongyloides* and *Wuchereria; Acanthamoeba* and other amoebae, *Cryptosporidium, Fasciola, Hartmanella, Acanthamoeba, Giardia lamblia, Isospora belli, Leishmania, Naegleria, Plasmodium* spp., *Pneumocystis carinii, Schistosoma* spp., *Toxoplasma gondii*, and *Trypanosoma* spp., among other viruses, bacteria, archaea, protozoa, fungi, and the like.

The present invention also provides approaches for increasing and decreasing MHC binding by adjustment of amino acids in an MHC binding peptide where such peptides are from epitopes derived from proteins from noninfectious sources, including but not limited to endogenous epitopes associated with autoimmune diseases, tumor associated antigens, and allergens. These are addressed in more detail below.

Many of the major non-infectious diseases cause characteristic epitopes to be displayed on the surface of cells. Cancers may be divided into two types, those associated with an underlying viral etiology and those which arise from a mutation of genes which control cell growth and division. In both cases, the surface epitopes may differ from normal cells either through expression of viral coded epitopes or overexpression of normal self proteins (e.g., HER-2 human epidermal growth factor receptor 2 overexpression in some breast cancers) (Sundaram et al. 2002. Biopolymers 66:200-216). The appearance of distinct epitopes offers the opportunity to target immunotherapies and vaccines to tumor cells (Sundaram et al., 2002 Biopolymers (Pept Sci), 66:200-216; Loo and Mather. 2008. Curr. Opin. Pharmacol. 8:627-631; Reichertand and Valge-Archer. 2007. Nat. Rev. Drug Discov. 6:349-356; King et al. 2008. QJM. 101:675-683).

Accordingly, in some embodiments, the protein or peptide sequence information used to identify epitopes is from a cancer or tumor. Examples include, but are not limited to, sequence information from bladder carcinomas, breast carcinomas, colon carcinomas, kidney carcinomas, liver carcinomas, lung carcinomas, including small cell lung cancer, esophagus carcinomas, gall-bladder carcinomas, ovary carcinomas, pancreas carcinomas, stomach carcinomas, cervix carcinomas, thyroid carcinomas, prostate carcinomas, and skin carcinomas, including squamous cell carcinoma and basal cell carcinoma; hematopoietic tumors of lymphoid lineage, including leukemia, acute lymphocytic leukemia, acute lymphoblastic leukemia, B-cell lymphoma, T-cell-lymphoma, Hodgkin's lymphoma, non-Hodgkin's lymphoma, hairy cell lymphoma and Burkett's lymphoma; hematopoietic tumors of myeloid lineage, including acute and chronic myclogenous leukemias, myelodysplastic syndrome and promyelocytic leukemia; tumors of mesenchymal origin, including fibrosarcoma and rhabdomyosarcoma; tumors of the central and peripheral nervous system, including astrocytoma, neuroblastoma, glioma and schwannomas; and other tumors, including melanoma, seminoma, teratocarcinoma, osteosarcoma, xeroderma pigmentosum, keratoxanthoma, thyroid follicular cancer and Kaposi's sarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, leiomyosarcoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma. In some embodiments, sequence information from individual proteins from the cancer cells are analyzed for epitopes according the process of the present invention. In some embodiments, sequence information from a set of proteins, such as transmembrane proteins, from the cancer cells are analyzed for epitopes according to the process of the present invention.

A number of diseases have also been identified as the result of autoimmune reactions in which the body's adaptive immune defenses are turned upon itself. Among the diseases recognized to be the result of autoimmunity, or to have an autoimmune component are celiac disease, narcolepsy, rheumatoid arthritis and multiple sclerosis (Jones, E. Y. et al, 2006. Nat. Rev. Immunol. 6:271-282). In a number of other instances infections are known to lead to a subsequent autoimmune reaction, including, for example but not limited to, in Lyme Disease, Streptococcal infections, and chronic respiratory infections (Hildenbrand, P. et al, 2009. Am. J. Neuroradiol. 30:1079-1087; Lee, J. L. et al, Autoimmun. Rev. 10.1016 0.2009; Leidinger, P. et al Respir. Res. 10:20, 2009). Enhanced ability to define and characterize peptides which form epitopes on the surface of cells in autoimmune will therefore facilitate the development of interventions which can ameliorate such diseases. Accordingly, in some embodiments, sequence information from cells that are involved in an autoimmune reaction or disease is analyzed according to the methods of the present invention. In some embodiments, sequence information from individual proteins from the cells are analyzed for epitopes according the process of the present invention. In some embodiments, sequence information from a set of proteins, such as transmembrane proteins, from the cells are analyzed for epitopes according to the process of the present invention.

In some particular embodiments the autoimmune diseases are those affecting the skin, which often cause autoimmune blistering diseases. These include but are not limited to pemphigus vulgaris and pemphigus foliaceus, bullous pemphigoid, paraneoplastic pemphigus, pemphigoid gestationis, mucous membrane pemphigus, linear IgA disease, Anti-Laminin pemphigoid, and epidermolysis bullosa aquisitiva. Some of the proteins which have been implicated as the target of the autoimmune response include desmogelin 1, 3 and 4, E-adherin, alpha 9 acetyl choline receptor, pemphaxin, plakoglobin, plakin, envoplakin, desmoplakin, BP 180, BP230, desmocholin, laminin, type VII collagen, tissue transglutaminase, endomysium, anexin, ubiquitin, Castlemans disease immunoglobulin, and gliadin. This list is illustrative and should not be considered limiting. In some instances peptides which bind antibodies and thus contain B cell epitopes have been described. Giudice et al., Bullous pemphigoid and herpes gestationis autoantibodies recognize a common non-collagenous site on the BP180 ectodomain. J Immunol 1993, 151:5742-5750; Giudice et al., Cloning and primary structural analysis of the bullous pemphigoid autoantigen BP180. J Invest Dermatol 1992, 99:243-250; Salato et al., Role of intramolecular epitope spreading in pemphigus vulgaris. Clin Immunol 2005, 116:54-64; Bhol et al., Correlation of peptide specificity and IgG subclass with pathogenic and nonpathogenic autoantibodies in pemphigus vulgaris: a model for autoimmunity. Proc Natl Acad Sci USA 1995, 92:5239-5243. Further T cell epitopes have been characterized Hacker-Foegen et al., T cell receptor gene usage of BP180-specific T lymphocytes from patients with bullous pemphigoid and pemphigoid gestationis. Clin Immunol 2004, 113:179-186. However, no systematic attempt has been made to plot the occurrence of all MHC binding regions and B cell eptopes in the proteins associated with cutaneous autoimmune disease, nor to determine the coincidence of B-cell epitopes with high affinity MHC binding regions.

In some embodiments, the present invention provides peptides from the aforementioned proteins associated with cutaneous autoimmune diseases which have characteristics of B cell epitopes and which bind with high affinity to MHC molecules, whether those two features are in overlapping or contiguous peptides or peptides that are bordering within 3 amino acids of each other.

A number of autoimmune disorders have been linked to immune responses triggered by infectious organisms which bear immune mimics of self-tissue epitopes. Examples include, but are not limited to, Guillan Bane (Yuki N (2001) Lancet Infect Dis 1 (1): 29-37, Yuki N (2005) Curr Opin Immunol 17 (6): 577-582; Kieseier B C et al, (2004) Muscle Nerve 30 (2): 131-156), rheumatoid arthritis (Rashid T et al (2007) Clin Exp Rheumatol 25 (2): 259-267), rheumatic fever (Guilherme L, Kalil J (2009) J Clin Immunol). In one embodiment the computer based analysis system described herein allows characterization of epitope mimics and can be applied to a variety of potential mimic substrates, including but not limited to vaccines, biotherapeutic drugs, food ingredients, to enable prediction of whether an adverse reaction could arise through exposure of an individual to a molecular mimic and which individuals (i.e. comprising which HLA haplotypes) may be most at risk.

Allergy is another example of an immune epitope mediated disease. The present invention in one particular embodiment is applicable to the modification of allergen peptides to induce immunosuppression or tolerization or to generate a vaccine against the allergen. Among the protein allergens from which peptides may be identifies as epitopes and modified are those listed in the SDAP Structural database (see the website at Fermi.utmb.edu/SDAP/index.html): These include abut are not limited to allergens derived from the following species *Acarus siro, Actinidia chinensis, Actinidia deliciosa, Aedes aegyptii, Alnus glutinosa, Alternaria alternate, Amaranthus retroflexus, Ambrosia artemisiifolia, Ambrosia psilostachya, Ambrosia trifida, Ananas comosus, Anacardium occidentale, Anisakis simplex, Anthoxanthum odoratum, Apis cerana, Apis dorsata, Apium graveolens, Apis mellifera, Arachis hypogaea, Arabidopsis thaliana, Archaeopotamobius sibiriensis, Argas reflexus, Artemia franciscana, Artemisia vulgaris, Prunus persica, Ascaris lumbricoides, Ascaris suum, Aspergillus fumigatus, Aspergillus flavus, Aspergillus niger, Aspergillus oryzae, Aspergillus versicolor, Asparagus officinalis, Bertholletia excelsa, Betula verrucosa (Betula pendula), Beta vulgaris, Blattella germanica, Blomia tropicalis, Bombus pennsylvanicus, Bombus terrestris, Bombyx mori, Bos domesticus, Brassica juncea, Brassica napus, Brassica oleracea, Brassica rapa, Brugia malayi, Canis familiaris (Canis domesticus), Candida albicans, Candida boidinii, Capsicum annuum, Carpinus betulus, Carya illinoinensis, Carica papaya, Castanea sativa, Catharanthus roseus, Cavia porcellus, Charybdis feriatus, Chamaecyparis obtusa, Chenopodium album, Chironomus kiiensis, Chironomus thummi thummi, Citrus limon, Citrus reticulata, Citrus sinensis, Cladosporium cladosporioides, Cladosporium herbarum, Clupea harengus, Coffea arabica, Coprinus comatus, Corylus avellana, Crangon crangon, Crassostrea gigas, Crocus sativus, Cryptomeria japonica, Ctenocephalides felis felis, Cucumis melo, Culicoides nubeculosus, Cupressus arizonica, Cupressus sempervirens, Curvularia lunata (Cochliobolus lunatus), Cynodon dactylon, Cyprinus carpio, Dactylis glomerate, Daucus carota, Dendronephthya nipponica, Dermatophagoides farinae, Dermatophagoides microceras, Dermatophagoides pteronyssinus, Dictyocaulus viviparus, Dirofilaria immitis, Dolichovespula arenaria, Dolichovespula maculata, Epicoccum purpurascens, Equus caballus, Euroglyphus maynei, Fagopyrum esculentum, Fagus sylvatica, Fagopyrum tataricum, Felis domesticus, Festuca pratensis, Forcipomyia taiwana, Fragaria ananassa, Fraxinus excelsior, Fusarium culmorum, Fusarium solani, Gadus callarias, Gadus morhua, Gallus domesticus, Glossina morsitans morsitans, Glycyphagus domesticus, Glycine max, Haliotis diversicolor, Haliotis midae, Harmonia axyridis, Helianthus annuus, Helix aspersa, Hevea brasiliensis, Holcus lanatus, Homarus americanus, Homo sapiens, Hordeum vulgare, Humulus japonicus, Juglans nigra, Juglans regia, Juniperus ashei, Juniperus oxycedrus, Juniperus sabinoides, Juniperus virginiana, Lactuca sativa, Lens culinaris, Lepidoglyphus destructor, Lepisma saccharina, Lepidorhombus whiffiagonis, Ligustrum vulgare, Liposcelis bostrichophila, Litchi chinensis, Litopenaeus vannamei, Lolium perenne, Lupinus angustifolius, Lycopersicon esculentum, Malus domestica, Malassezia furfur, Malassezia sympodialis, Manihot esculenta, Mercurialis annua, Metapenaeus ensis, Mimachlamys nobilis, Morus nigra, Musa acuminata, Mus musculus, Myrmecia pilosula, Olea europea, Oncorhynchus mykiss, Oreochromis mossambicus, Oryctolagus cuniculus, Oryza sativa, Ostrya carpinifolia, Pandalus borealis, Panulirus stimpsoni, Parietaria judaica, Parietaria officinalis, Paspalum notatum, Penaeus aztecus, Penicillium brevicompactum, Penicillium citrinum, Penicillium chrysogenum* (formerly *P. notatum*), *Penicillium crustosum, Penaeus indicus, Penaeus monodon, Penicillium oxalicum, Periplaneta americana, Perna viridis, Persea americana, Petroselinum crispum, Phalaris aquatica, Phaseolus vulgaris, Phleum pratense, Phoenix dactylifera, Pisum savitum, Pistacia vera, Platanus x acerifolia (Platanus acerifolia), Plantago lanceolata, Platanus orientalis, Plodia interpunctella, Poa pratensis, Polistes annularies, Polistes dominulus, Polistes exclamans, Polistes fuscatus, Polistes gallicus, Polistes metricus, Polybia paulista, Polybia scutellaris (P. scutellaris rioplatensis), Pontastacus leptodactylus, Prunus armeniaca, Prunus avium, Prunus domestica, Prunus dulcis, Psilocybe cubensis, Pyrus communis, Quercus alba, Rana esculenta, Rattus norvegius, Rhodotorula mucilaginosa, Ricinus communis, Rubus idaeus, Salsola kali, Salmo salar, Sardinops sagax, Schizophyllum commune, Scomber australasicus, Scomber japonicus, Scomber scombrus, Sebastes marinus, Secale cereale, Sesamum indicum, Sinapis alba, Solenopsis geminata, Solenopsis invicta, Solenopsis richteri, Solenopsis saevissima, Solanum tuberosum, Sorghum halepense, Stachybotrys chartarum, Syringa vulgaris, Tabanus yao, Taraxacum officinale, Thaumetopoea pityocampa, Theragra chalcogramma, Thunnus albacares, Todarodes pacificus, Triticum aestivum, Trichophyton rubrum, Trichophyton tonsurans, Triatoma protracta, Triplochiton scleroxylon, Tyrophagus putrescentiae, Vespula flavopilosa, Vespula germanica, Vespula maculifrons, Vespula pennsylvanica, Vespula squamosa, Vespula vulgaris, Vespula vidua, Vespa crabro, Vespa mandarins, Vespa magnifica, Vigna radiata, Vitis vinifera, Xiphias gladius, Zea mays, Ziziphus mauritiana.*

Modification of Imunogenicity of Biopharmaceuticals

A particular group of proteins which may be antigenic are biopharmaceuticals. Many proteins are used as therapeutics and protein drugs are the fastest growing. There are many classes of protein drug but a particularly large group comprise recombinant antibodies and antibody fusions. As foreign or non self proteins introduced into the body the biotherapeutic protein is taken up and processed by antigen presenting cells and processed for presentation to T cells as a pMHC complex. Many biotherapeutics elicit an adverse reaction, most often inducing antibodies which act as inhibitors. The process of development of biotherpautics which involves manipulation of amino acids to increase antibody affinity or to humanize the antibody introduces motifs which are seen as antigenic. A particular embodiment of the present invention therefore is to identify epitopes within biotherapeutic proteins and to permit the simulation of amino acid changes which can increase or decrease MHC binding of particular peptides. In some particular embodiments the application of the present invention is to design biotherapeutics which are particularly appropriate for patients of certain MHC alleles.

Orientation of the Binding Peptide

The binding of a peptide within a MHC molecular groove is a function of binding affinity, and space shape of the molecule determining the fit. As shown in PCT/US2011/029192, binding affinity can be predicted based on multiple physical parameters of the constituent amino acids of a peptide. Cleavage by cathepsin cuts the protein, or sub sequences therefor to release a 9-mer or a 10-mer, a 15-mer, or a 11-22-mer, or other size of peptide which binds in the MHC I or MHC II groove. It is a general practice of those skilled in the art to analyze protein amino acid sequences starting from the N terminal and moving towards the C terminal, a direction which may be termed canonical. Within the environment of an intracellular space where a MHC-peptide binding reaction takes place there is no such convention and consequently a binding space shape fit may be achieved in either canonical or non-canonical orientation. The present invention examines situations where both canonical and non-canonical pMHC binding occurs and provides a computer implemented process for predicting MHC binding to peptides in either orientation.

Relationship of B and T Cell Responses

We have previously demonstrated that proteins comprise B cell epitopes, MHC binding and cathepsin cleavage which often are placed in close proximity to each other to constitute an epitope dense region or immunological kernel (See, e.g., PCT/US2011/029192, Bremel and Homan, 2013 supra) in which all signals necessary to coordinate an immune response are present. On the establishment of a B cell synapse the B cell receptor and B cell epitope binding is followed by internalization of a sequence of the protein containing the aforesaid binding point. In the process those sequences immediately adjacent to the B cell epitope are most likely to be internalized simultaneously and give rise to pMHC complexes and surface presentation on B cells towards T cells.

In some instances however epitope maps of proteins identify B cell linear epitopes which occur separated from high affinity MHC binding regions, these are T independent B cell epitopes and are unlikely to generate a specific memory.

Vaccination may have as its goal the upregulation of the immune response to generate antibodies and a cytotoxic T cell response to eliminate an exogenous epitope such as one residing on a pathogen or a tumor cell. In other instances vaccination may have as its goal the induction of tolerization or immunosuppression to prevent or mitigate autoimmunity or allergy. The goal of vaccination is typically to induce a long term immunological memory in which re-exposure results in an anamnestic response. In other instances the goal may be to calibrate the duration of a specific immune response and reduce either the antibody response or the cytotoxic T cell response. Under such circumstances it may be beneficial to be able to identify epitopes which stimulate one arm of the immune response but not the other. In some specific embodiments therefor an antibody response without a T cell response may be desired; one example of this which is non-limiting is in Alzheimers disease (Ghochikyan A et al Neurosci Lett. 2014). In yet other embodiments a T cell response in the absence of an antibody response may be the preferred outcome. The present invention, by allowing detailed mapping of epitopes, provides the tools for the identification and selection of epitopes for incorporation in a vaccine based on whether they will induce an antibody response, cellular response, or both. The present invention allows selection of amino acid sequences with precision which have the desired combination of B cell epitopes and high affinity MHC binding sequences needed for T cell epitopes.

Identification of Immunological Kernels

B-cell epitopes may be linear peptide sequences of varying length or may depend on three dimensional topology comprising multiple short peptide sequences. In contrast, T-cell epitopes lie within short linear peptide sequences (e.g., 8-mers or 9-mers up to 15-mers with or without a few N- or C-terminal flanking residues which are bound by the MHC receptor after proteasomal processing (Janeway 2001. Immunobiology. Garland Publishing). T-cell epitopes have multiple roles in vaccination controlling the outcome of both antibody mediated and cell-mediated responses (Kaufmann 2007). As has been previously demonstrated (Bremel and Homan, 2013, supra and PCT/US2011/029192) there is a commonly occurring intraprotein organization in which B cell epitopes are typically flanked by a cathepsin cleavage site on one side of a B cell linear epitope and a sequence of amino acids starting 3-7 amino acids on the other side of the linear B cell epitope in which there are multiple overlaid peptides which have high affinity for biding to multiple MHC molecules, including both MHC I and MHC II. This relationship is shown in FIG. 1. While the location within a protein of such an immunological kernel may be identified by mapping by the computer assisted methods described herein and in a prior filing (uTOPE 1), given the frequent association of B-cell epitopes and MHC binding, it is possible to utilize B cell linear epitopes as a marker for the adjacent MHC binding peptides. In such an application the B cell binding or antibody binding sequence is determined and a sequence of amino acids selected extending 20-30 amino acids from that B cell binding epitope, in preferred embodiments extending towards the C terminal but in some other embodiments on the N terminal side of the B cell epitope. The present invention therefore comprises using a B cell linear epitope as a marker and selection tool for identification and isolation of a MHC binding peptide. Not all sequences flanking a B cell epitope will provide a high affinity MHC binding peptide but the probability of a MHC binding peptide is higher starting within 3-10 amino acids adjacent to the B linear cell epitope and extending up to 30-40 amino acids from such an epitope.

Epitope Analysis of *Brucella* Spp

The present invention enables the high throughput processing of whole microbial proteomes to identify sequences of interest as epitopes, particularly with a view to development of vaccines comprising synthetic peptides. As discussed above *Brucella* spp cause a heavy disease toll on both humans and animals and the development of an effective vaccine is a long sought after goal.

Brucellosis is most prevalent zoonosis worldwide (WHO (2006) The control of neglected zoonotic diseases; Report of a Joint WHO/DFID-AHP Meeting with the participation of FAO and OIE. Geneva; Pappas G et at (2006) The new global map of human brucellosis. Lancet InfectDis 6: 91-99. Brucellosis is a debilitating chronic disease for those naturally infected through exposure to bacteria in milk and placental fluids of ruminant livestock (Corbel M J (1997) Brucellosis: an overview. EmergInfectDis 3: 213-221). As infection also occurs by inhalation of aerosols and the infective dose is low, *Brucella melitensis* is a potential bioterror agent with capacity to infect large numbers of people. A model developed by the CDC of a bioterrorist attack scenario on a U.S. city with aerosolized *B. melitensis* estimated a financial impact of $477.7 million per 100,000 people exposed Kaufmann A F, et at (1997) The economic impact of a bioterrorist attack: are prevention and postattack intervention programs justifiable? EmergInfectDis 3: 83-94); less deadly but far more costly than an anthrax attack.

No effective vaccine exists to protect humans from brucellosis. Several weeks of antibiotic treatment are required, but may be unable to clear residual foci of bacteria. Historically, vaccines developed to control disease in cattle, sheep, and goats, the main natural reservoir, are comprised of live attenuated *Brucella* organisms, still capable of causing disease in humans. Killed organisms are ineffective vaccines. DNA and subunit recombinant vaccines offer the potential of safety but have yet to provide long lasting or broad coverage. A safe and effective vaccine suitable for human use is needed to offer protection to those facing occupational exposure, and to provide large scale protection and post-exposure intervention in the face of deployment of brucellosis as a bioterror weapon. The longer incubation period of brucellosis offers the opportunity to implement post-exposure vaccination in the face of mass exposure to enhance clearance.

In one embodiment therefore the present invention has been applied to analyze multiple complete proteomes of *Brucella* spp and identify epitope dense regions of amino acids which when expressed as synthetic proteins can serve as vaccine components. In particular the present invention is useful for identifying epitopes that are conserved across different strains of an infectious microorganism.

Vaccines

Vaccines are considered to be the most effective medical intervention (Rappuoli et al. 2002. Science 297:937-939), reducing the burden of infectious diseases which kill millions worldwide. A comprehensive reverse vaccinology approach leading to identification of multiple peptides capable of inducing both antibody and cell mediated responses will allow rational design of vaccines to be achieved more rapidly, more precisely, and to produce more durable protection, while avoiding deleterious cross reactivities. By distilling down the epitope to the minimal effective size, from protein to peptide, we can facilitate engineering of delivery vehicles to display an array of several epitopes, inducing an immunity which poses multiple barriers to escape mutation. Reverse vaccinology, assisted by our invention, has particular potential for controlling emerging pathogens where vaccines or epitope targeting drugs can be designed and implemented based on genome sequences even before in vitro culture systems are worked out.

In some embodiments, the present invention provides a vaccine comprising one or more of the polypeptides which comprise epitopes as described above. In some embodiments, the present invention provides compositions comprising one or more of the polypeptides described above and an adjuvant. In some embodiments, the vaccines comprise recombinant or synthetic polypeptides derived from a transmembrane protein from a target cell or organisms that comprises one or more B-cell epitopes and/or peptides that bind to one or more members of an MHC or HLA superfamily. Suitable target cells and organisms include, but are not limited to, prokaryotic and eukaryotic organisms, bacteria, archaea, protozoas, viruses, fungi, helminthes, carcinomas, tumors, cancer cells, etc. as described in detail above.

As used herein, the term "vaccine" refers to a composition comprising any combination of peptides or single peptide formulation. There are various reasons why one might wish to administer a vaccine of a combination of the peptides of the present invention rather than a single peptide. Depending on the particular peptide that one uses, a vaccine might have superior characteristics as far as clinical efficacy, solubility, absorption, stability, toxicity and patient acceptability are concerned. It should be readily apparent to one of ordinary skill in the art how one can formulate a vaccine of any of a number of combinations of peptides of the present invention. There are many strategies for doing so, any one of which may be implemented by routine experimentation.

The peptides of the present invention may be administered as a single agent therapy or in addition to an established therapy, such as inoculation with live, attenuated, or killed virus, or any other therapy known in the art to treat the target disease or epitope-sensitive condition.

The appropriate dosage of the peptides of the invention may depend on a variety of factors. Such factors may include, but are in no way limited to, a patient's physical characteristics (e.g., age, weight, sex), whether the compound is being used as single agent or adjuvant therapy, the type of MHC restriction of the patient, the progression (i.e., pathological state) of the infection or other epitope-sensitive condition, and other factors that may be recognized by one skilled in the art. In general, an epitope or combination of epitopes may be administered to a patient in an amount of from about 50 micrograms to about 5 mg; dosage in an amount of from about 50 micrograms to about 500 micrograms is especially preferred.

In some embodiments, the peptides are expressed on bacteria, such as lactococcus and lactobacillus, or expressed on virus or virus-like particles for use as vaccines. In some embodiments, the peptides are incorporated into other carriers as are known in the art. For example, in some embodiments, the polypeptides comprising one or more epitopes are conjugated or otherwise attached to a carrier protein. Suitable carrier proteins include, but are not limited to keyhole limpet hemocyanin, bovine serum albumin, ovalbumin, and thyroglobulin. In yet other embodiments the polypeptide may be fused to an Fc region of an immunoglobulin for delivery to a mucosal site bearing corresponding receptors.

One may administer a vaccine of the present invention by any suitable method, which may include, but is not limited to, systemic injections (e.g., subcutaneous injection, intradermal injection, intramuscular injection, intravenous infusion) mucosal administrations (e.g., nasal, ocular, oral, vaginal and anal formulations), topical administration (e.g., patch delivery), or by any other pharmacologically appropriate technique. Vaccination protocols using a spray, drop, aerosol, gel or sweet formulation are particularly attractive and may be also used. The vaccine may be administered for delivery at a particular time interval, or may be suitable for a single administration.

Vaccines of the invention may be prepared by combining at least one peptide with a pharmaceutically acceptable liquid carrier, a finely divided solid carrier, or both. As used herein, "pharmaceutically acceptable carrier" refers to a carrier that is compatible with the other ingredients of the formulation and is not toxic to the subjects to whom it is administered. Suitable such carriers may include, for example, water, alcohols, natural or hardened oils and waxes, calcium and sodium carbonates, calcium phosphate, kaolin, talc, lactose, combinations thereof and any other suitable carrier as will be recognized by one of skill in the art. In a most preferred embodiment, the carrier is present in an amount of from about 10 uL (micro-Liter) to about 100 uL.

In some embodiments, the vaccine composition includes an adjuvant. Examples of adjuvants include, but are not limited to, mineral salts (e.g., aluminum hydroxide and aluminum or calcium phosphate gels); oil emulsions and surfactant based formulations (e.g., MF59 (microfluidized detergent stabilized oil-in-water emulsion), QS21 (purified saponin), Ribi Adjuvant Systems, AS02 [SBAS2] (oil-in-water emulsion+MPL+QS-21), Montanide ISA-51 and ISA-720 (stabilized water-in-oil emulsion); particulate adjuvants (e.g., virosomes (unilamellar liposomal vehicles incorporating influenza haemagglutinin), ASO4 ([SBAS4] Al salt with MPL), ISCOMS (structured complex of saponins and lipids), polylactide co-glycolide (PLG); microbial derivatives (natural and synthetic), e.g., monophosphoryl lipid A (MPL), Detox (MPL+M. Phlei cell wall skeleton), AGP [RC-529] (synthetic acylated monosaccharide), DC_Chol (lipoidal immunostimulators able to self organize into liposomes), OM-174 (lipid A derivative), CpG motifs (synthetic oligonucleotides containing immunostimulatory CpG motifs), modified LT and CT (genetically modified bacterial toxins to provide non-toxic adjuvant effects); endogenous human immunomodulators (e.g., hGM-CSF or hIL-12 (cytokines that can be administered either as protein or plasmid encoded), Immudaptin (C3d tandem array); and inert vehicles, such as gold particles. In various embodiments, vaccines according to the invention may be combined with one or more additional components that are typical of pharmaceutical formulations such as vaccines, and can be identified and incorporated into the compositions of the present invention by routine experimentation. Such additional components may include, but are in no way limited to, excipients such as the following: preservatives, such as ethyl-p-hydroxybenzoate; suspending agents such as methyl cellulose, tragacanth, and sodium alginate; wetting agents such as lecithin, polyoxyethylene stearate, and polyoxyethylene sorbitan mono-oleate; granulating and disintegrating agents such as starch and alginic acid; binding agents such as starch, gelatin, and acacia; lubricating agents such as magnesium stearate, stearic acid, and talc; flavoring and coloring agents; and any other excipient conventionally added to pharmaceutical formulations.

Further, in various embodiments, vaccines according to the invention may be combined with one or more of the group consisting of a vehicle, an additive, a pharmaceutical adjunct, a therapeutic compound or agent useful in the treatment of the desired disease, and combinations thereof.

In another aspect of the present invention, a method of creating a vaccine is provided. The method may include identifying an immunogenic epitope; synthesizing a peptide epitope from the immunogenic epitope; and creating a composition that includes the peptide epitope in a pharmaceutical carrier. The composition may have characteristics similar to the compositions described above in accordance with alternate embodiments of the present invention. Accordingly, the present invention provides vaccines and therapies for a variety of infections and clinical conditions. These infections and conditions include, but are not limited to, Mediterranean fever, undulant fever, Malta fever, contagious abortion, epizootic abortion, Bang's disease, brucellosis, *Salmonella* food poisoning, enteric paratyphosis, Bacillary dysentery, *Pseudotuberculosis*, plague, pestilential fever, Tuberculosis, Vibrios, Circling disease, Weil's disease, Hemorrhagic jaundice (Leptospira icterohaemorrhagiae), canicola fever (*L. canicola*), dairy worker fever (*L. hardjo*), Relapsing fever, tick-borne relapsing fever, spirochetal fever, vagabond fever, famine fever, Lyme arthritis, Bannworth's syndrome, tick-borne meningopolyneuritis, erythema chronicum migrans, Vibriosis, Colibacteriosis, colitoxemia, white scours, gut edema of swine, enteric paratyphosis, Staphylococcal alimentary toxicosis, staphylococcal gastroenteritis, Canine Corona Virus (CCV) or canine parvovirus enteritis, feline infectious peritonitis virus, transmissible gastroenteritis (TGE) virus, Hagerman Redmouth Disease (ERMD), Infectious Hematopoietic necrosis (IHN), porcine *Actinobacillus* (*Haemophilus*) pleuropneumonia, Hansen's disease, Streptotrichosis, Mycotic Dermatitis of Sheep, Pseudoglanders, Whitmore's disease, Francis' disease, deer-fly fever, rabbit fever, O'Hara disease, Streptobacillary fever, Haverhill fever, epidemic arthritic erythema, sodoku, Shipping or transport fever, hemorrhagic septicemia, Ornithosis, Parrot Fever, Chlamydiosis, North American blastomycosis, Chicago disease, Gilchrist's disease, Cat Scratch Fever, Benign Lymphoreticulosis, Benign nonbacterial Lymphadenitis, Bacillary Angiomatosis, Bacillary Peliosis Hepatitis, Query fever, Balkan influenza, Balkan grippe, abattoir fever, Tick-borne fever, pneumorickettsiosis, American Tick Typhus, Tick-borne Typhus Fever, Vesicular Rickettsiosis, Kew Gardens Spotted Fever, Flea-borne Typhus Fever, Endemic Typhus Fever, Urban Typhus, Ringworm, Dermatophytosis, Tinea, Trichophytosis, Microsporosis, Jock Itch, Athlete's Foot, Sporothrix schenckii, dimorphic fungus, Cryptococcosis and histoplasmosis, Benign Epidermal Monkeypox, Herpesvirus simiae, Simian B Disease, Type C lethargic encephalitis, Yellow fever, Black Vomit, hantavirus pulmonary syndrome, Korean Hemorrhagic Fever, Nephropathia Epidemica, Epidemic Hemorrhagic Fever, Hemorrhagic Nephrosonephritis, lymphocytic choriomeningitis, California encephalitis/La Crosse encephalitis, African Hemorrhagic Fever, Green or Vervet Monkey Disease, Hydrophobia, Lyssa, Infectious hepatitis, Epidemic hepatitis, Epidemic jaundice, Rubeola, Morbilli, Swine and Equine Influenza, Fowl Plague, Newcastle disease, Piroplasmosis, toxoplasmosis, African Sleeping Sickness, Gambian Trypanosomiasis, Rhodesian Trypanosomiasis, Chagas's Disease, Chagas-Mazza Disease, South American Trypanosomiasis, Entamoeba histolytica, Balantidial dysentery, cryptosporidiosis, giardiasis, Cutaneous leishmaniasis; Bagdad boil, Delhi boil, Baum ulcer, Visceral leishmaniasis: kala-azar, Microsporidiosis, Anisakiasis, Trichinosis, Angiostrongylosis, eosinophilic meningitis or meningoencephalitis (*A. cantonensis*), abdominal angiostrongylosis (*A. costaricensis*), Uncinariasis, Necatoriasis, Hookworm Disease, Capillariasis, Brugiasis, Toxocariasis, Oesophagostomiasis, Strongyloidiasis, Trichostrongylosis, Ascaridiasis, Diphyllobothriasis, Sparganosis, Hydatidosis, Hydatid Disease, *Echinococcus granulosis*, Cystic hydatid disease, Tapeworm Infection, Schistosomiasis and the like. Malignant diseases caused by infectious pathogens are contemplated as well. The examples of such diseases include for example Burkitt's lymphoma caused by EBV, Rous sarcoma caused by Rous retrovirus, Kaposi' sarcoma caused by herpes virus type 8, adult T-cell leukemia caused by HTLV-I retrovirus, or hairy cell leukemia caused by HTLV-II, and many other tumors and leukemias caused by infectious agents and viruses. Further it may provide vaccines and therapies for emerging diseases yet to be defined, whether emerging from natural reservoirs or resulting from exposure to genetically engineered bioterror organisms.

In still further embodiments, the present invention provides vaccine compositions which may be applied for treatment of cancer. In some embodiments, the vaccines comprise recombinant or synthetic polypeptides from a transmembrane protein from a cancer cell that comprises one or more B-cell epitopes and/or peptides that bind to one or more members of an MHC or HLA superfamily. The polypeptides are identified as described above. In some embodiments, the polypeptides are attached to a carrier protein and/or used in conjunction with an adjuvant. Examples of can that can be treated include, but are not limited to, bladder carcinomas, breast carcinomas, colon carcinomas, kidney carcinomas, liver carcinomas, lung carcinomas, including small cell lung cancer, esophagus carcinomas, gall-bladder carcinomas, ovary carcinomas, pancreas carcinomas, stomach carcinomas, cervix carcinomas, thyroid carcinomas, prostate carcinomas, and skin carcinomas, including squamous cell carcinoma and basal cell carcinoma; hematopoietic tumors of lymphoid lineage, including leukemia, acute lymphocytic leukemia, acute lymphoblastic leukemia, B-cell lymphoma, T-cell-lymphoma, Hodgkin's lymphoma, non-Hodgkin's lymphoma, hairy cell lymphoma and Burkett's lymphoma; hematopoietic tumors of myeloid lineage, including acute and chronic myclogenous leukemias, myelodysplastic syndrome and promyelocytic leukemia; tumors of mesenchymal origin, including fibrosarcoma and rhabdomyosarcoma; tumors of the central and peripheral nervous system, including astrocytoma, neuroblastoma, glioma and schwannomas; and other tumors, including melanoma, seminoma, teratocarcinoma, osteosarcoma, xeroderma pigmentosum, keratoxanthoma, thyroid follicular cancer and Kaposi's sarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, leiomyosarcoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma.

In another embodiment the present invention provides therapies for a variety of autoimmune diseases which may include but are not limited to Ankylosing Spondylitis, Atopic allergy, Atopic Dermatitis, Autoimmune cardiomyopathy, Autoimmune enteropathy, Autoimmune hemolytic anemia, Autoimmune hepatitis, Autoimmune inner ear disease, Autoimmune lymphoproliferative syndrome, Autoimmune peripheral neuropathy, Autoimmune pancreatitis, Autoimmune polyendocrine syndrome, Autoimmune progesterone dermatitis, Autoimmune thrombocytopenic purpura, Autoimmune uveitis, Bullous Pemphigoid, Castleman's disease, Celiac disease, Cogan syndrome, Cold agglutinin disease, Crohns Disease, Dermatomyositis, Diabetes mellitus type 1, Eosinophilic fasciitis, Gastrointestinal pemphigoid, Goodpasture's syndrome, Graves' disease, Guillain-Barré syndrome, Anti-ganglioside Hashimoto's encephalitis, Hashimoto's thyroiditis, Systemic Lupus erythematosus, Miller-Fisher syndrome, Mixed Connective Tissue Disease, Myasthenia gravis, Narcolepsy, Pemphigus vulgaris, Polymyositis, Primary biliary cirrhosis, Psoriasis, Psoriatic Arthritis, Relapsing polychondritis, Rheumatoid arthritis, Sjögren's syndrome, Temporal arteritis, Ulcerative Colitis, Vasculitis, and Wegener's granulomatosis.

Antibodies

In some embodiments, the present invention provides for the development of antigen binding proteins (e.g., antibodies or fragments thereof) that bind to a polypeptide as described above. Monoclonal antibodies are preferably prepared by methods known in the art, including production of hybridomas, use of humanized mice, combinatorial display techniques, and the like. See, e.g., of Kohler and Milstein, Nature, 256:495 (1975), Wood et al., WO 91/00906, Kucherlapati et al., WO 91/10741; Lonberg et al., WO 92/03918; Kay et al., WO 92/03917 [each of which is herein incorporated by reference in its entirety]; N. Lonberg et al., Nature, 368:856-859 [1994]; L. L. Green et al., Nature Genet., 7:13-21 [1994]; S. L. Morrison et al., Proc. Nat. Acad. Sci. USA, 81:6851-6855 [1994]; Bruggeman et al., Immunol., 7:33-40 [1993]; Tuaillon et al., Proc. Nat. Acad. Sci. USA, 90:3720-3724 [1993]; and Bruggernan et al. Eur. J. Immunol., 21:1323-1326 [1991]); Sastry et al., Proc. Nat. Acad. Sci. USA, 86:5728 [1989]; Huse et al., Science, 246:1275 [1989]; and Orlandi et al., Proc. Nat. Acad. Sci. USA, 86:3833 [1989]); U.S. Pat. No. 5,223,409; WO 92/18619; WO 91/17271; WO 92/20791; WO 92/15679; WO 93/01288; WO 92/01047; WO 92/09690; WO 90/02809 [each of which is herein incorporated by reference in its entirety]; Fuchs et al., Biol. Technology, 9:1370-1372 [1991]; Hay et al., Hum. Antibod. Hybridomas, 3:81-85 [1992]; Huse et al., Science, 46:1275-1281 [1989]; Hawkins et al., J. Mol. Biol., 226:889-896 [1992]; Clackson et al., Nature, 352:624-628 [1991]; Gram et al., Proc. Nat. Acad. Sci. USA, 89:3576-3580 [1992]; Garrad et al., Bio/Technolog, 2:1373-1377 [1991]; Hoogenboom et al., Nuc. Acid Res., 19:4133-4137 [1991]; and Barbas et al., Proc. Nat. Acad. Sci. USA, 88:7978 [1991].

The antigen binding proteins of the present invention include chimeric and humanized antibodies and fragments thereof, including scFv's. (See e.g., Robinson et al., PCT/US86/02269; European Patent Application 184,187; European Patent Application 171,496; European Patent Application 173,494; WO 86/01533; U.S. Pat. No. 4,816,567; European Patent Application 125,023 [each of which is herein incorporated by reference in its entirety]; Better et al., Science, 240:1041-1043 [1988]; Liu et al., Proc. Nat. Acad. Sci. USA, 84:3439-3443 [1987]; Liu et al., J. Immunol., 139:3521-3526 [1987]; Sun et al., Proc. Nat. Acad. Sci. USA, 84:214-218 [1987]; Nishimura et al., Canc. Res., 47:999-1005 [1987]; Wood et al., Nature, 314:446-449 [1985]; and Shaw et al., J. Natl. Cancer Inst., 80:1553-1559 [1988]), U.S. Pat. No. 5,225,539 (incorporated herein by reference in its entirety); Jones et al., Nature, 321:552-525 [1986]; Verhoeyan et al., Science, 239:1534 [1988]; and Beidler et al., J. Immunol., 141:4053 [1988]).

Applications

The method of the present invention are useful for a wide variety of applications, including but not limited to, the design and development of vaccines, biotherapeutic antigen binding proteins, diagnostic antigen binding proteins, and biotherapeutic proteins.

In some embodiments, the methods of the present invention are used to identify peptides that bind to one or more MHC or HLA binding regions. This application is highly useful in the development, design and evaluation of vaccines and the polypeptides included in the vaccine that are intended to initiate an immune response. In some embodiments, the methods of the present invention allow for the determination of the predicted binding affinities of one or more MHC binding regions for polypeptide(s)(and the epitopes contained therein) that is included in a vaccine or is a candidate for inclusion in a vaccine. Application of these methods identifies epitopes that are bound by particular MHC binding regions with high affinity, but at only low affinity by other MHC binding regions. Thus, the effectiveness of the epitopes for vaccination of population, subpopulation or individual with a particular haplotype can be determined. Thus, the processes of the present invention allow identification of populations or individuals that are predicted to be more or less responsive to the vaccine. If desired, the vaccine can then be designed to target a subset of the population with particular MHC binding regions or be designed to provide an immunogenic response in a high percentage of subjects within a population or subpopulation, for example, greater than 50%, 60%, 70%, 80%, 90%, 95% or 99% of all subjects within a population or subpopulation. The present invention therefore facilitates design of vaccines with selected polypeptides with a predicted binding affinity for MHC binding regions, and thus which are designed to elicit an immune response in defined populations (e.g., subpopulations or the entire population or a desired/target percentage of the population).

These methods are particularly applicable to the design of subunit vaccines that comprise isolated polypeptides. In some embodiments, polypeptides selected for a vaccine bind to one or more MHC binding regions with a predicted affinity for at least one MHC binding region of about greater than $10^5$ $M^{-1}$, about greater than $10^6$ $M^{-1}$, about greater than $10^7$ $M^{-1}$, about greater than $10^8$ $M^{-1}$, or about greater than $10^9$ $M^{-1}$. In some embodiments, these binding affinities are achieved for about 1% to 5%, 5% to 10%, 10% to 50%, 50% to 100%, 75% to 100% or 90% to 100% or greater than 90%, 95%, 98%, or 99% of subjects within a population or subpopulation.

It is also contemplated that different microorganism strains, viral strains or protein isotypes will vary in their ability to elicit immune responses from subjects with particular binding regions. Accordingly, the methods of the present invention are useful for selecting particular microorganism strains, viral strains or protein isotypes that are including in a vaccine. As above, the methods of the present invention allow for the determination of the predicted binding affinities of one or more MHC binding regions for epitopes contained in the proteome of an organism or protein isotype that are included vaccine or are candidates for inclusion in a vaccine. Application of these methods identifies epitopes that are bound by particular MHC binding regions with high affinity, but at only low affinity by other MHC binding regions. This process allows identification of populations or individuals that are predicted to be more or less responsive to the vaccine. If desired, the vaccine can then be designed to target a subset of the population with particular MHC binding regions or be designed to provide coverage of a high percentage of subjects within a population or subpopulation, for example, greater than 50%, 60%, 70%, 80%, 90%, 95% or 99% of all MHC subjects within a population or subpopulation. The present invention therefore facilitates design of vaccines with selected strains of an organism or virus or protein isotype, and thus which are designed to elicit an immune response in defined populations (e.g., subpopulations or the entire population or a desired/target percentage of the population). In some embodiments, strains of an organism or virus or protein isotype selected for a vaccine bind to one or more MHC binding regions with a predicted affinity for at least one MHC binding region of about greater than $10^5$ $M^{-1}$, about greater than $10^6$ $M^{-1}$, about greater than $10^7$ $M^{-1}$, about greater than $10^8$ $M^{-1}$, or about greater than $10^9$ $M^{-1}$. In some embodiments, these binding affinities are achieved for from one individual to about 1% to 5%, 5% to 10%, 10% to 50%, 50% to 100%, 75% to 100% or 90% to 100% or greater than 70%, 80%, 90%, 95%, 98%, 99%, 99.5% or 99.9% of subjects within a defined population or defined subpopulation.

Accordingly, these methods are particularly applicable to the development, design and/or production of therapeutic vaccines. In some embodiments, vaccines are designed to optimize the response of an individual patient of known MHC allotype. In these embodiments, the vaccine is designed to include epitopes that have a high predicted binding affinity for one or more MHC alleles in a subject. For example, in some embodiments, the vaccine comprises 1, 2, 3, 4, 5, 10 or 20 peptides with a predicted affinity for at least one MHC binding region of about greater than $10^5$ $M^{-1}$, about greater than $10^6$ $M^{-1}$, about greater than $10^7$ $M^{-1}$, about greater than $10^8$ $M^{-1}$, or about greater than $10^9$ $M^{-1}$. In some embodiments, the epitope is immunogenic for subjects whose HLA alleles are drawn from a group comprising 1, 5, 10 or 20 or more different HLA alleles. In some embodiments, the epitope is selected to be immunogenic for the HLA allelic composition of an individual patient.

Biopharmaceuticals are an increasing percentage of therapeutics approved and in development. As more protein drugs are more widely used, adverse reactions arising from immune response to the protein drugs are more commonly recognized, often among a narrow sector of the patient population of specific immunogenetics. There has been an increasing interest in de-antigenizing biopharmaceuticals. This is true of antibody-based biopharmaceuticals and replacement enzyme, hormone and blood clotting factor therapies. It is therefore of interest to be able to modify biopharmaceuticals to reduce the antigenicity of certain epitopes for certain patient genetic groups. In some instances this could lead to the development of multiple biopharmaceutical products with the same therapeutic goal but designed for specific patient groups. In some instances the target epitope is a peptide that ensures a T helper cell response (CD4) by binding to a MHC-II molecule; in other instances the epitope of interest binds to a MHC-I and induces a cytotoxic T cell response. In yet other embodiments the binding induces a Treg response.

As more allergens are characterized and there is better understanding of the epitopes which give rise to allergic reactions there is interest in developing peptides which can be used to tolerize or desensitize allergic individuals by inducing anergy. In some instances such peptides capable of inducing anergy have a higher binding affinity for MHC molecules than the allergen.

T cell receptors are somewhat promiscuous in their recognition of peptide-MHC combinations; it is recognized that the most important amino acids in the binding peptide are the central 5 amino acids both in the case of a 15-mer binding a MHC-II molecule and in the 9-mer binding MHC-I. For clarity in the following examples, FIG. 45 characterizes the peptide which binds in the MHC grooves as comprising 3 zones, two flanking sequences A and C and a core 5-mer shown as B.

Accordingly, embodiments of the present invention provide compositions and methods for optimizing MHC binding of peptide ligands (e.g., for use in research, screening, and therapeutic (e.g., pharmaceutical)) applications. Exemplary compositions and methods are described, for example, in Examples 14 and 15 below.

The ability to predict MHC binding affinity of any 15-mer or 9-mer peptide based on the principal component analysis of the component amino acids lays the foundation for being able to rapidly simulate the binding affinity of large numbers of variant peptides to any given MHC allele or combinations of alleles. A very large number of possible variants may exist; however by selecting a random sample of for example, but not limited to, 5000 or 10000 or 1,000,000 possible combinations of amino acids based on the amino acid frequency in the parent protein, it is possible to rapidly arrive at a small number of peptides that fulfill the criteria of predicted binding affinity for HLA alleles of interest. This small subset can then be tested in vitro or in animal models. This represents a very significant savings in time and money over testing of all variants empirically without guidance as to the changes in MHC binding. The use of principal component analysis makes it possible to simulate changes in binding affinity rapidly by calculating the predicted binding affinity a set of peptide combinations which achieve the desired result from among the many millions of potential amino acid combinations. In one embodiment the present invention provides a process that rapidly identifies a group of 20 or 30 or up to 100 peptides, which comprise alternative epitopes with binding affinity of at least 2 standard deviations higher or lower than the original peptide. This is a group which is practicable to test to ensure that bioactivity is retained.

Example 1

Application of Principal Component Analysis to Modify Binding Affinity of Selected Peptides The following examples below show how purposefully varying the amino acid composition of one or more of the core or flanking sequences in a MHC binding peptide (see zones A, B, and C shown in FIG. 2) can produce different results, either increasing or decreasing the antigenicity of a selected peptide for a specific set of HLA alleles of interest. While the examples are intended to illustrate the concepts they are not limiting and the same, or generally similar procedures, can be applied to peptides selected from other proteins to achieve desired changed in antigenicity.

TABLE 2

Figure 2:
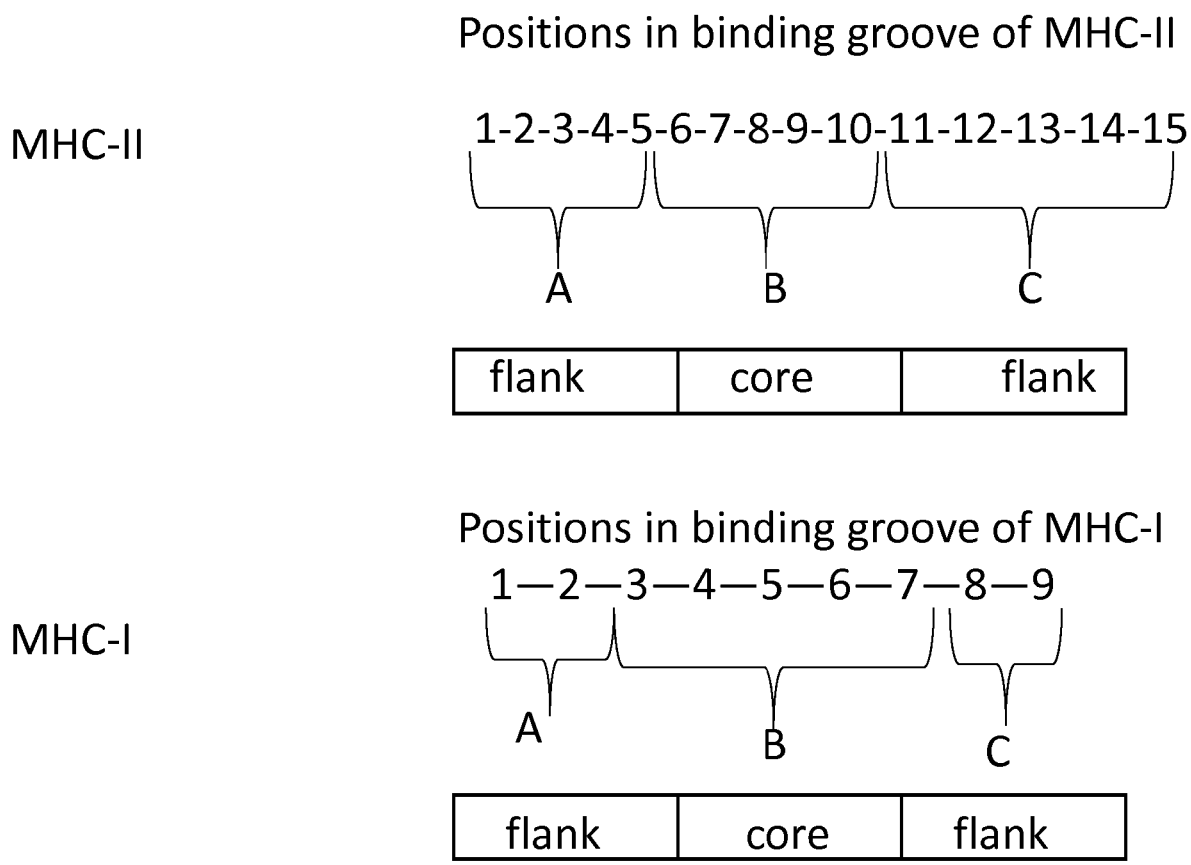
FIG. 2 illustrates the approach to optimization of a MHC binding peptide to achieve specific results. The central core 5 amino acids determine the T cell receptor binding; the flanking regions can be varied to change the MHC allele binding affinity. In the examples a combination of fixing and variation of the flanks (labeled as A and C) and core (labeled as B) are used.

| | Goal | Variations by Zone(as shown in FIG. 2) | | | Protein used in example |
|---|---|---|---|---|---|
| Example A | Increase affinity of MHC-II 15-mer | Flank Vary | Core Fix | Flank Vary | Ara h1 peanut allergen |
| Example B | Decrease antigenicity of MHC-II 15 mer | Flank Fix | Core Vary | Flank Fix | Immunoglobulin 1A9 heavy chain |
| Example C | Decrease antigenicity of MHC-II 15mer | Flank Fix Flank Vary | Core Fix Core Fix | Flank vary Flank Vary | Immunoglobulin 1A9 heavy chain |
| Example D | Increase binding affinity MHC-I 9 mer | Flank Vary | Core Fix | Flank Vary | Prostate specific Antigen |

Example 1 A

Maintaining the Core Sequence to Retain the T-Cell Recognition and Varying the Flanking Regions to Increase Predicted Binding Affinity to One or More MHC Alleles of Interest; Example Applied to Peanut Allergen Ara h1

The protein Ara h1 is a known allergen protein of peanuts. In this example, it is shown how the MHC binding of specific peptides can be increased by varying the flanking regions (Zone A and C) of a 15-mer.

A specific 15 mer peptide LNRHDNQNLRVAKIS (SEQ ID NO: 28415) from Ara h1 is modified to simultaneously increase the affinity for MHC-II alleles DRB1-0101 and DBR1-0301. The central 5 amino acids (zone B) are held constant as those are expected to be recognized by the T-cell receptor. For each flanking region (A and C) as 10 of 15 amino acids can be varied, there are $20^{10}$ possible variants. 10000 peptides were selected at random based on the overall frequency in the protein. The binding affinity based on the principal component analysis of each new 15 mer (A-B-C) was then evaluated to determine which peptide changes give increased affinity for the DRB alleles of interest while maintaining the core constant.

Figure 3:
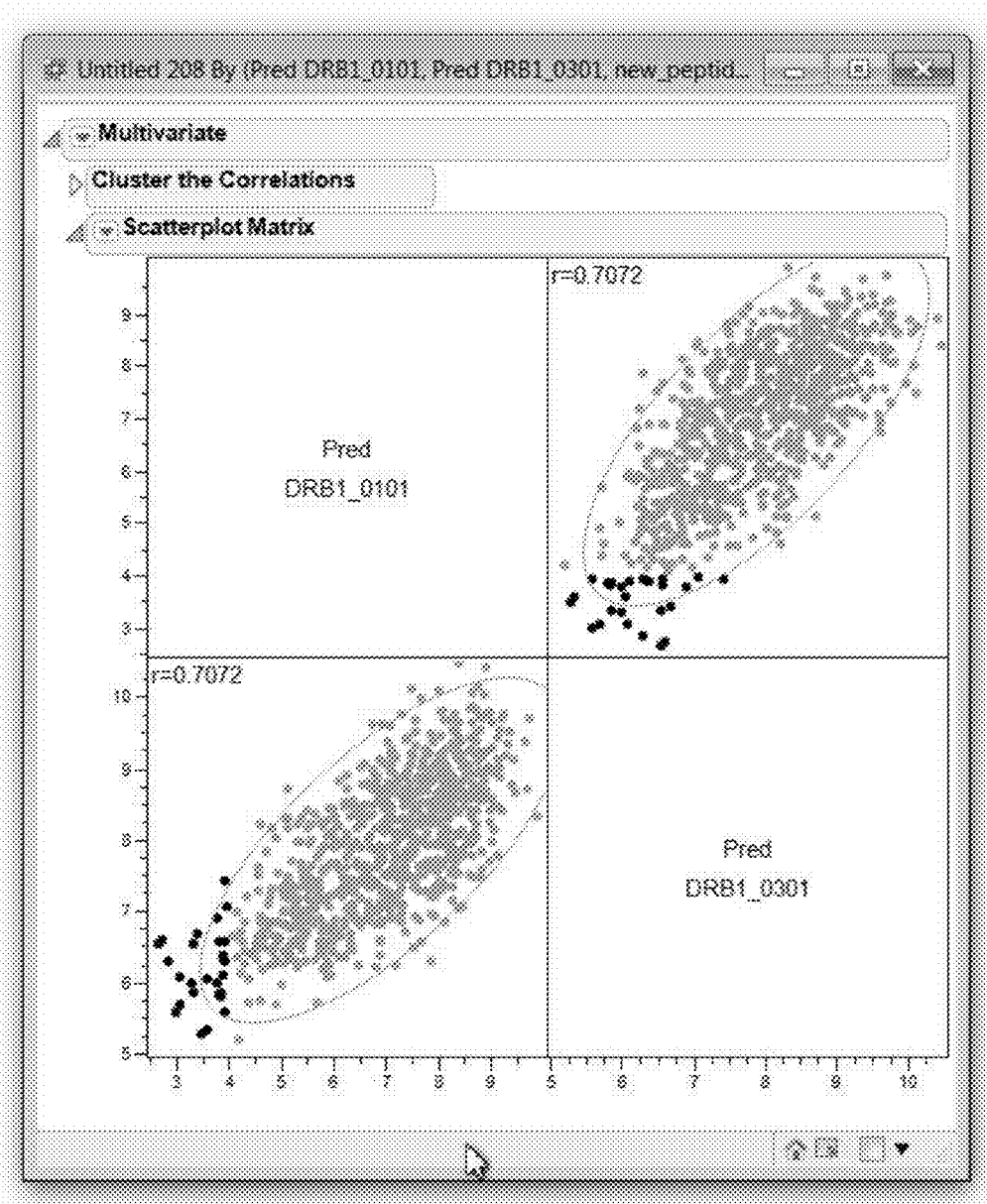
FIG. 3 shows the modification of the naturally occurring 15 mer peptide from peanut allergen Ara h1 LNRHDNQNLRVAKIS (SEQ ID NO: 28415) to maximize binding to two MHC-II alleles: DRB1*01:01 & DRB1*03:01. The right hand column in the table shows a subset of 10,000 peptides selected at random; this subset comprises 27 peptide variants, which have the same core 5 amino acids ~NQNLR~ (SEQ ID NO: 28424) and that offer the best binding to the two MHC alleles of interest. In the scatter plot showing all peptide variants tested the black dots show the best binders in the table. The ellipse is the 95% statistical confidence zone.
Figure 4:
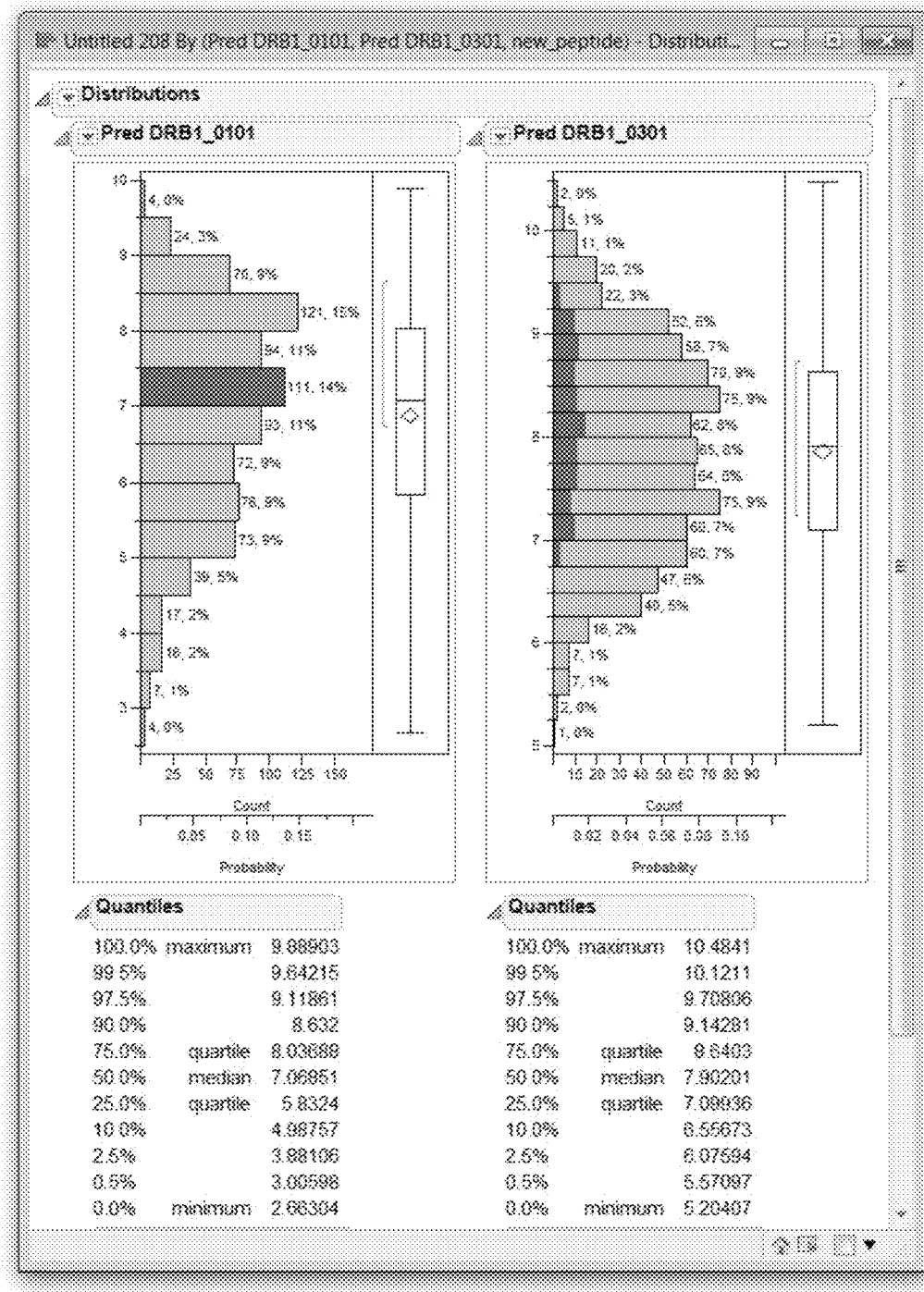
FIG. 4 shows that in the peanut allergen Ara h1 the selected peptide LNRHDNQNLRVAKIS (SEQ ID NO: 28415) in its native form is among 11 15 mer peptides that have a binding affinity for DRB1_0101 near the median for all 15mers in the parent protein. When the affinity of this subset is examined for binding to DRB1_0301 they are also seen to be within approximately the median 75% of binding affinity. In the right hand panel, the affinity of the best selected peptides shown in FIG. 46 is shown, lying in the highest 3% affinity for DRB1_0101 and the highest 15% for DRB1_0301.
Figure 4:
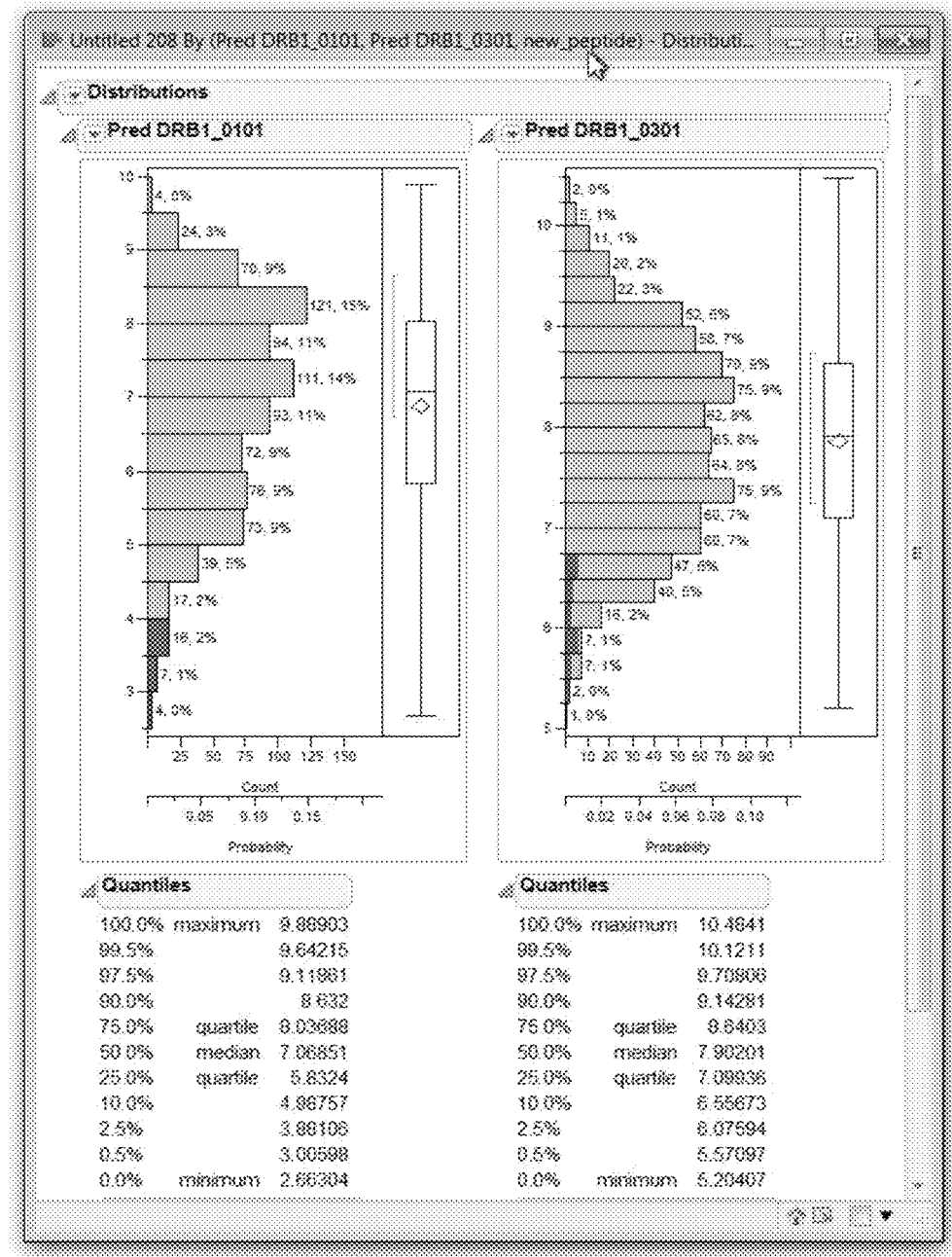

In FIGS. 3 and 4 the selected peptides are shown and their position as outliers of highest predicted binding affinity is shown. The predicted binding affinity of peptide LNRHDNQNLRVAKIS (SEQ ID NO: 28415) is found in the mid-region of the distribution and the peptides highlighted in these figures have an $e^3$ (approximately 20 fold) increase in predicted binding affinity for the two HLA alleles indicated. These are peptides suitable for testing as potential antigens for inducing anergy in individuals of this alleleic composition.

Example 1B

Maintaining the Flanking Sequences and the Binding to MHC Alleles of Interest while Varying the Core Region to Decrease Binding Affinity to T Cell Receptors: Application to an Immunoglobulin This example describes the reduction of recognition of a selected peptide by T cell receptors, while maintaining or increasing the predicted binding to, and occupancy of, MHC alleles of interest. This approach can be used, for example, to remove an adverse T cell stimulation to a biopharmaceutical protein molecule. In this instance the flanking 5mers (A and C in FIG. 2) are maintained constant and the core 5mer (B) is varied. The total possible permutations are $20^5$. A random 5000 5-mers are selected based on the amino acid frequency in the protein as a whole. Using principal component analysis the predicted binding affinity is determined.

Figure 5:
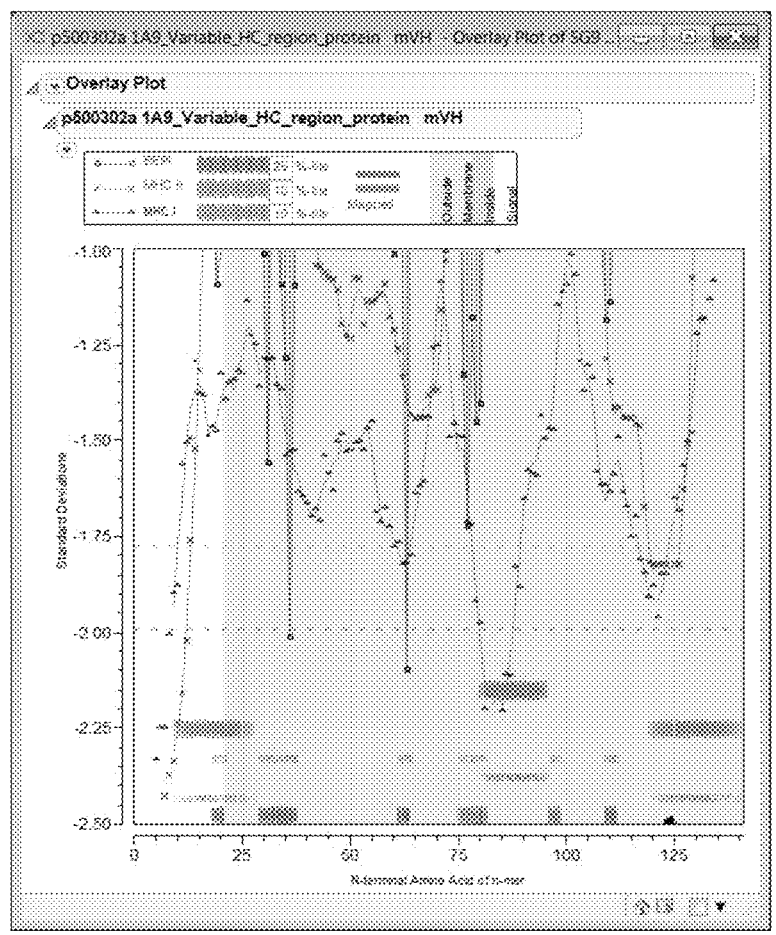
FIG. 5 shows (left hand panel) the permuted population average binding affinity of peptides in the heavy chain variable region of anti-cryptosporidial antibody 1A9. This plot was made using the methods described herein. The 15 mer peptide starting at position 124, which has a relatively high predicted binding affinity was selected for manipulation. The top right histogram shows the binding affinity of this peptide lies in the top 4% for DRB1_0101 and the top 12% for DRB1_0301 relative to all other 15 mer peptides in the parent protein. This high affinity is also shown in the scatterplot bottom right.
Figure 5:
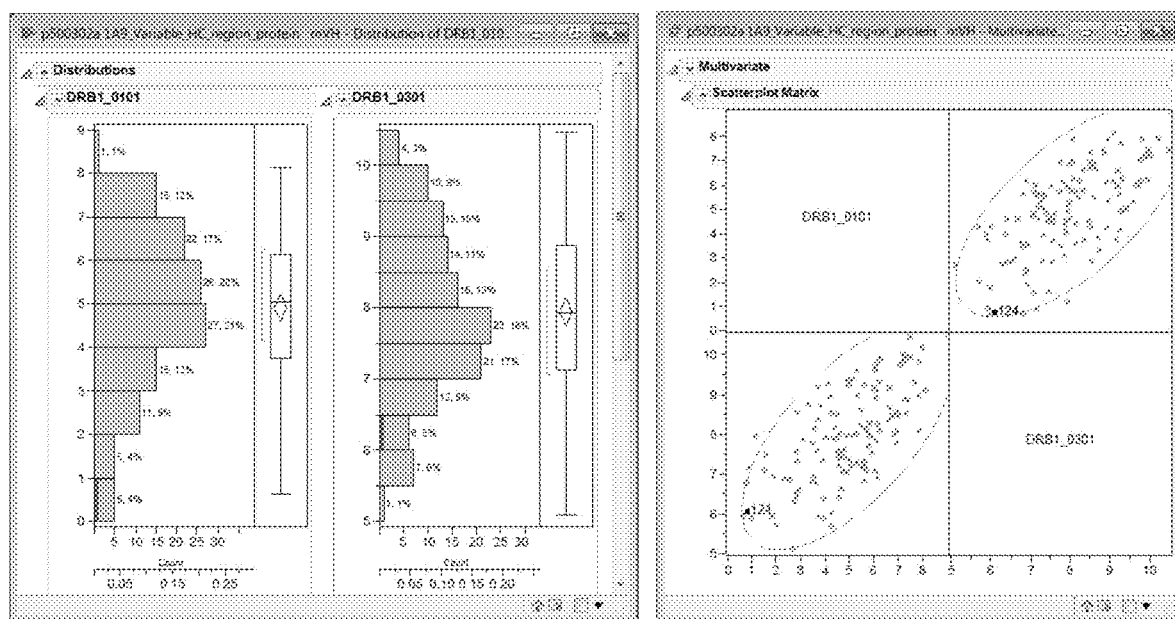
Figure 6:
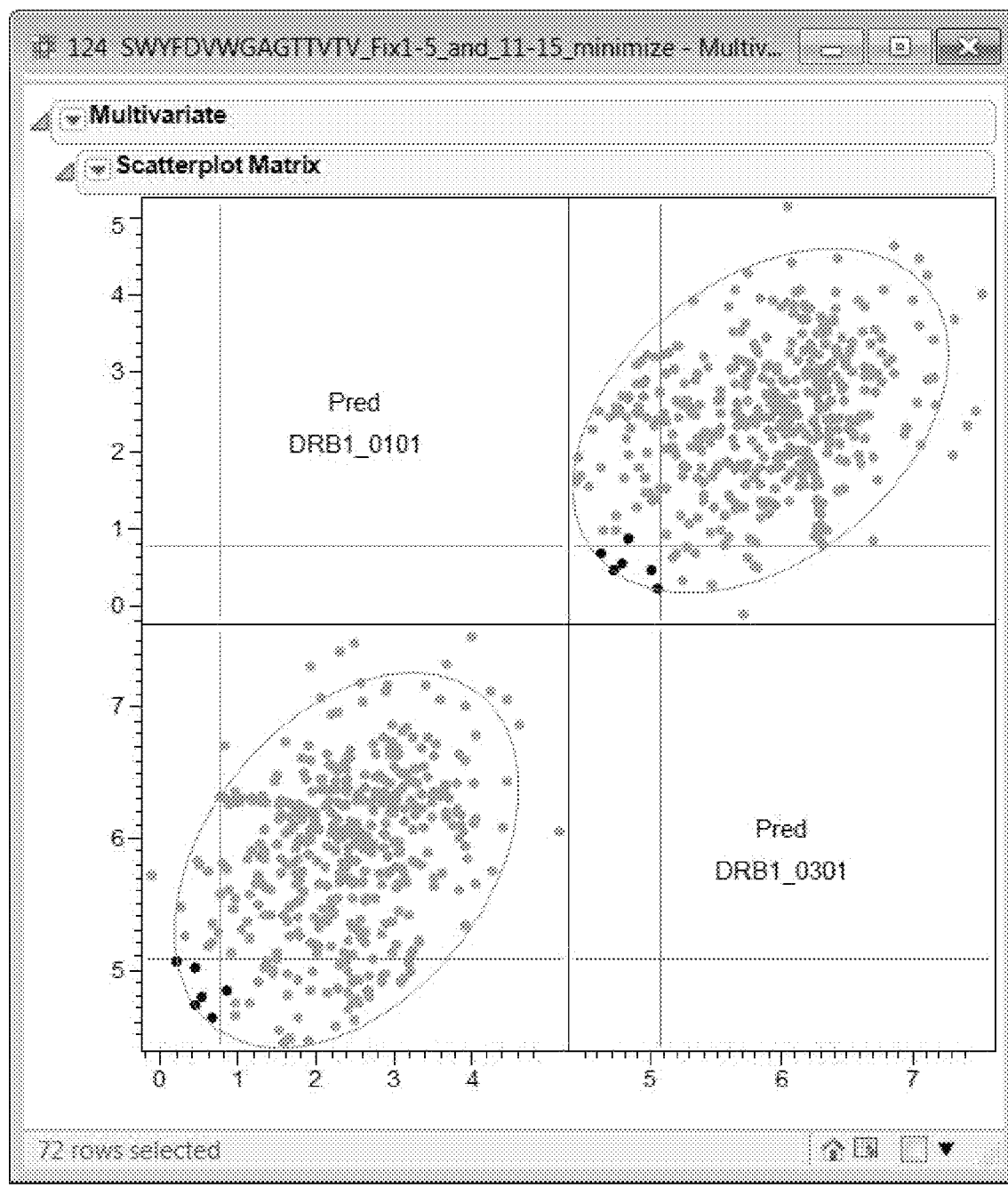
FIG. 6 shows that the 15mer peptide starting at 124 in heavy chain 1A9 has affinity for DRB1-0101 and DRB1_0301 lying at the intersection of the lines on the scatter plot. The black dots represent the alternative peptides selected in which the core 5 amino acids have been varied to change the T cell binding while maintaining the flanks unchanged. The scatter plot and histogram show the affinity for both of the selected peptides of interest are the same or higher as in the native peptide.
Figure 6:
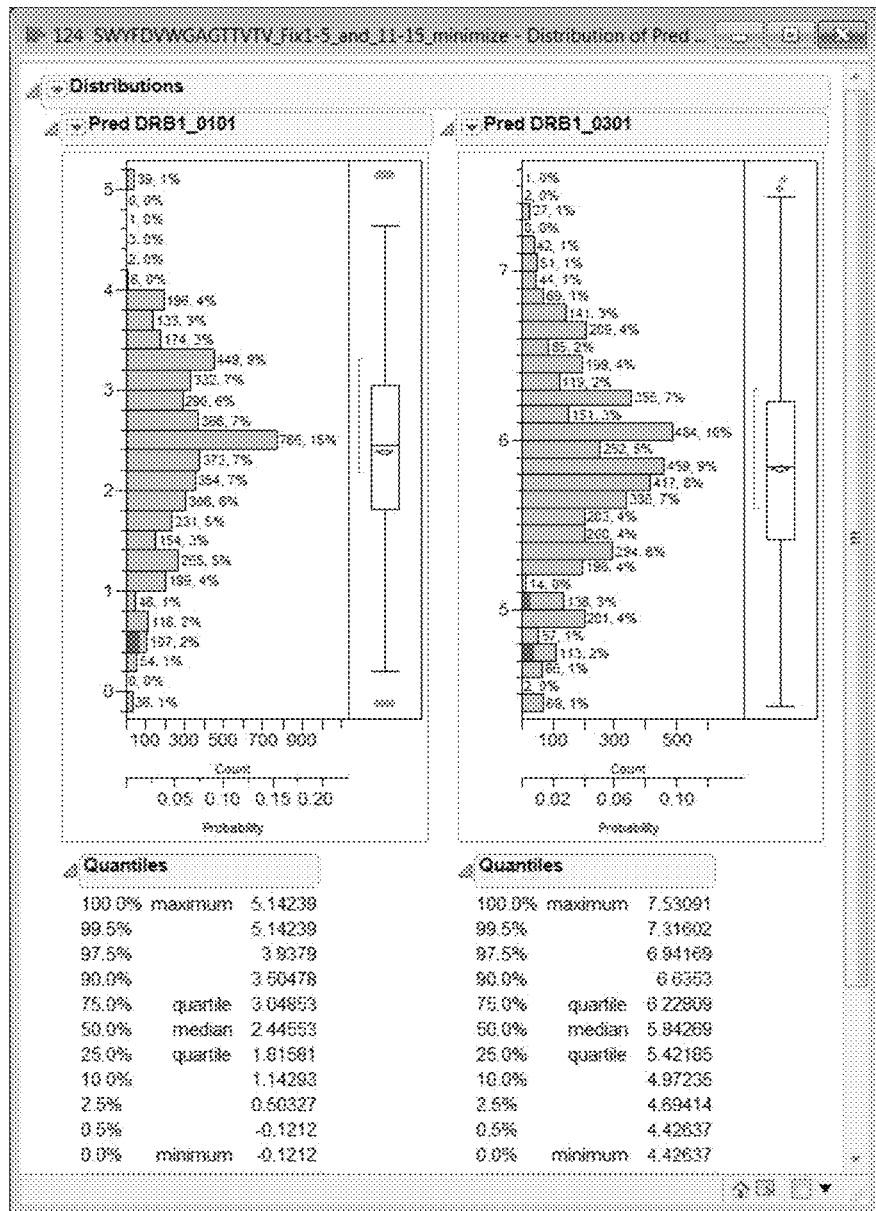
Figure 7:
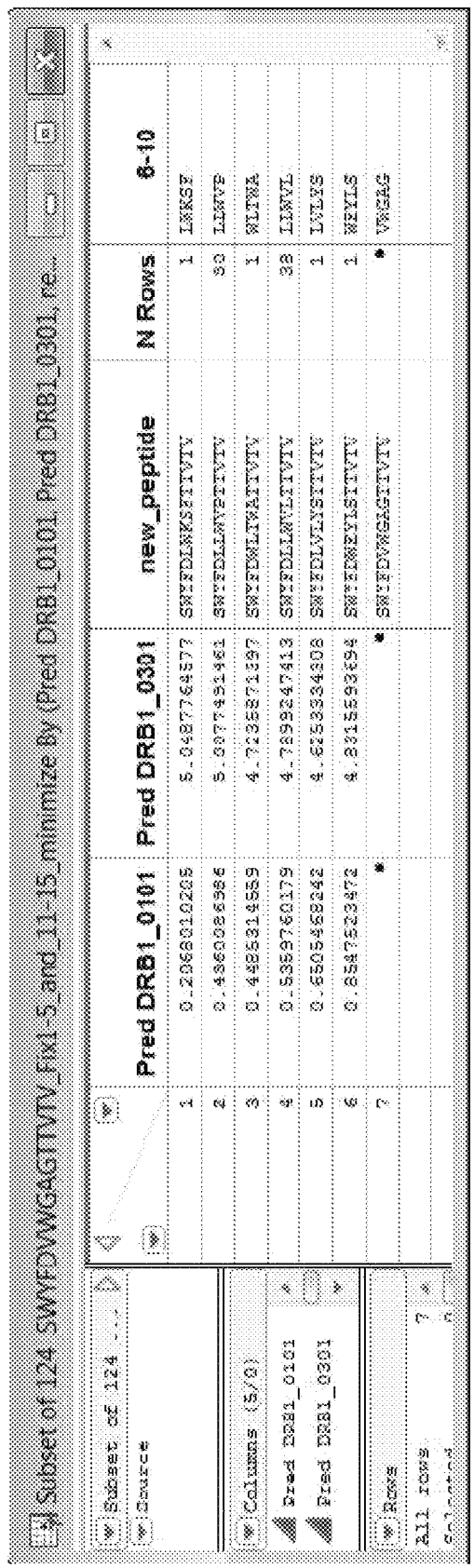
FIG. 7 shows that when a subset of 5000 15 mers variants of peptide 124 of antibody heavy chain variable region of 1A9 is used in which the flanks are fixed and core varied, 435 unique variants of the core 5 amino acids were generated, of which only 6 unique 5-mer variants met the criteria of maintaining high affinity binding for the alleles of interest, DRB1_0101 and DRB1_0301.

This example examined a selected peptide from the variable region of the heavy chain of an immunoglobulin 1A9. FIG. 5 shows the permuted distribution of predicted affinity to all peptides in this particular protein and shows histograms and scatter plot showing how the selected peptide, starting at position 124 a peptide that has a quite high predicted affinity for both of the target alleles, compares to other 15 mer peptides within the same protein, for two HLA alleles DRB1_0101 and DRB1_0301. The goal of the modification in this instance was to maintain the binding affinity for these MHC alleles the same or higher while changing the core 5mer. Of the possible $20^5$ variants, 5000 randomly optimized variants of the core 5-mer (B in FIG. 45) were generated based on the frequency of amino acids in the parent protein. This process produced 435 variants identified as unique (the random optimization process tends to identify certain peptides multiple times). Of these 435, 6 maintained affinity of binding to the MHC alleles of interest. Hence the selection process results in 6 peptides from the sample of 5000 that maintain or increase the binding to the MHC molecule but that are expected to bind to a corresponding T cell receptor more poorly if at all. These peptides are shown in FIGS. 6 and 7. In the scatterplot on FIG. 6 these are the dark peptides lying outside the lines showing the original binding affinity of peptide 124 to the two MHC alleles of interest. Each of the resultant 6 variants is then tested to determine the continued functionality of the protein of interest. The process described provides a rapid means of selecting candidates for testing that maintain all desired MHC binding characteristics. Effectively these 6 new peptides are epitope mimics of the original peptide.

Example 1C

Maintaining the Core Sequence and Varying Flanking Regions to Decrease Binding Affinity to One or More MHC Alleles of Interest: Application to an Immunoglobulin This example describes a method of reducing the predicted binding affinity of an MHC allele to one or more MHC alleles, thus reducing antigenicity. The approach is that of maintaining the core zone constant but changing the binding affinity of one or both flanking regions to vary how well the peptide is bound by the MHC molecule groove for the alleles of interest.

Figure 8:
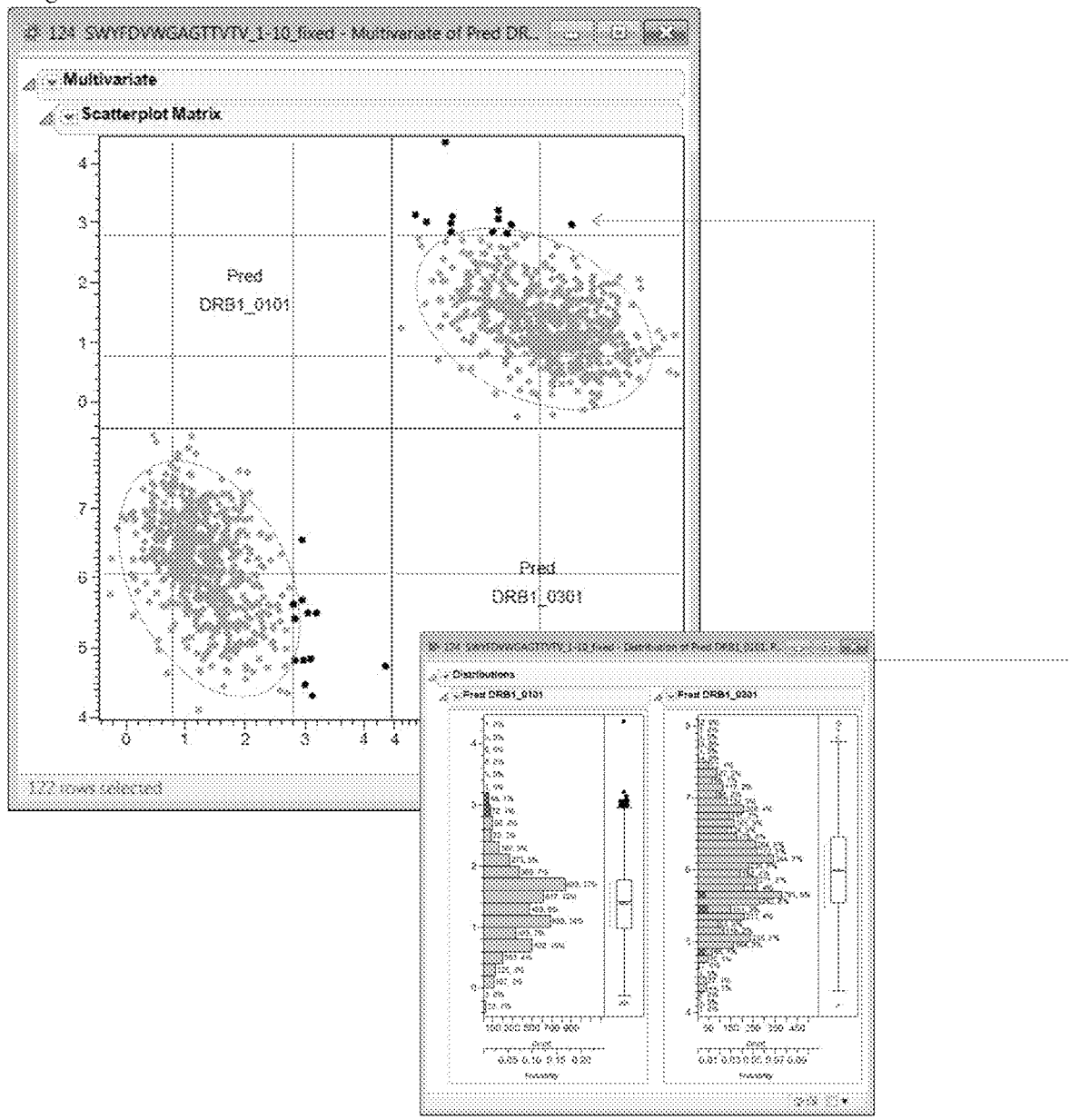
FIG. 8 shows a scatter plot of binding affinity of 15 mer peptides created by varying peptide 124 of antibody 1A9. The 5000 variants were created by holding amino acids 1-10 constant and varying the C terminal flank 5mer. The axes mark the binding affinity of the native peptide to DRB1_0101 and DRB1_0301. One variant peptide shows a higher binding affinity for both alleles and hence falls outside both axes.

Again using the 15 mer peptide initiating at amino acid position 124 of the heavy chain variable region of immunoglobulin 1A9, and maintaining 10 amino acids constant and varying the C terminal 5mer we evaluated the peptides which resulted in simultaneous reduced affinity for DRB1_0101 and DRB1_0301. As above, using a sample of 5000 peptides of the total $20^5$ possibilities, it would found that one variant resulted in a decreased affinity for DRB1_0101 (from $e^{0.8}$ to $e^{2.8}$) and simultaneously decreased affinity for DRB1_0301. Hence this method resulted in peptides that offered lower binding affinity and thus antigenicity. This is shown in FIG. 8.

Figure 9:
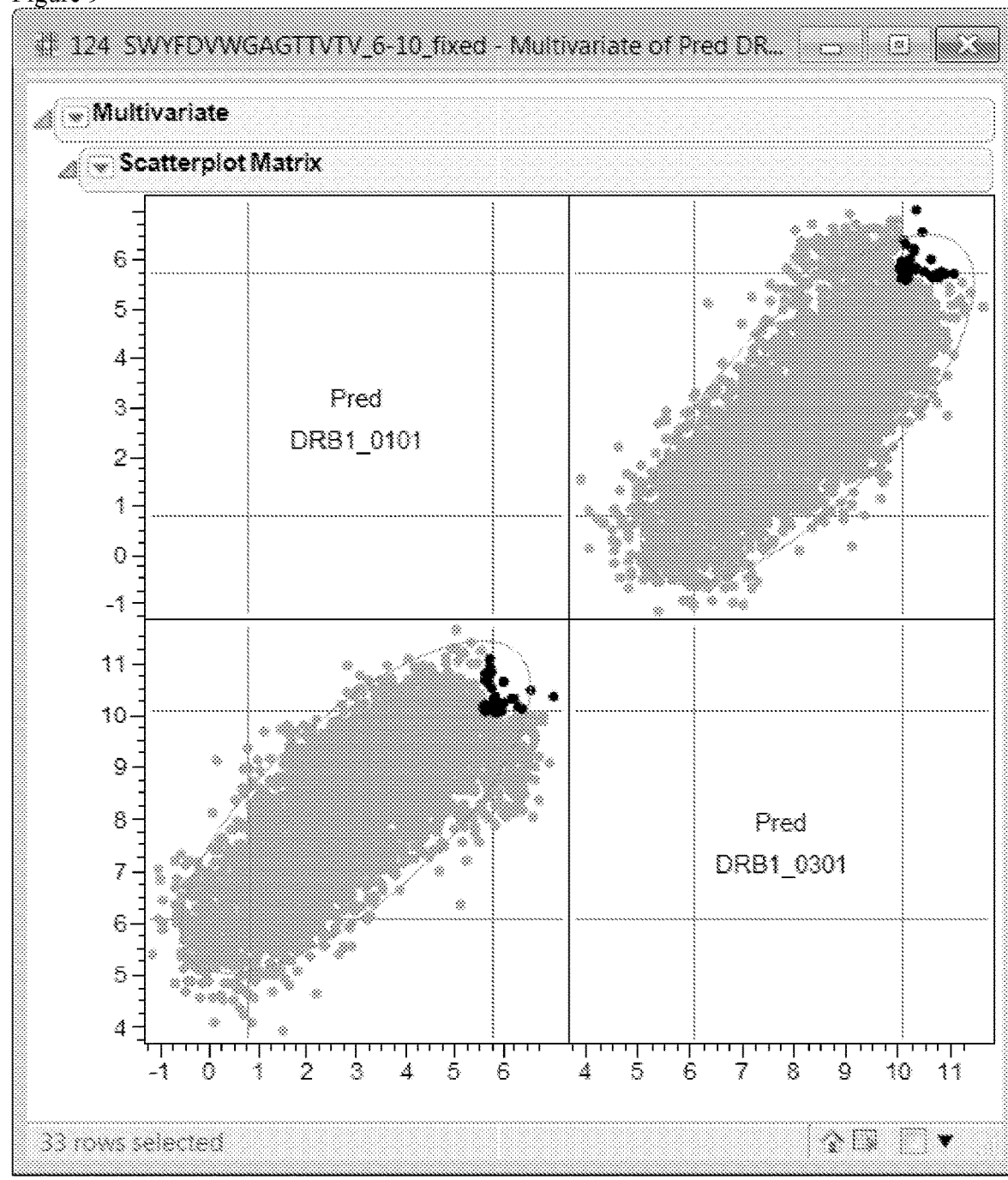
FIG. 9 shows a scatter plot of binding affinity of 15 mer peptides created by varying peptide 124 of antibody 1A9. The 5000 variants were created by holding amino acids 6-10 constant and varying both terminal flank 5mers. The axes mark the binding affinity of the native peptide to DRB1_0101 and DRB1_0301. In this case, 33 variant peptides are generated that show a higher binding affinity for both alleles and hence fall outside both axes.

When both flanking 5 mers were varied it was possible to generate 33 peptides from a sample of 5000 peptides, which had reduced binding for both alleles. In this case the 33 peptides achieved an $e^5$ reduction (148 fold lower) in binding for DRB1_0101 and an e4 (approximately 55 fold) reduction in binding for DRB1_0301. This is shown in FIG. 9.

Example 1D

Figure 10:
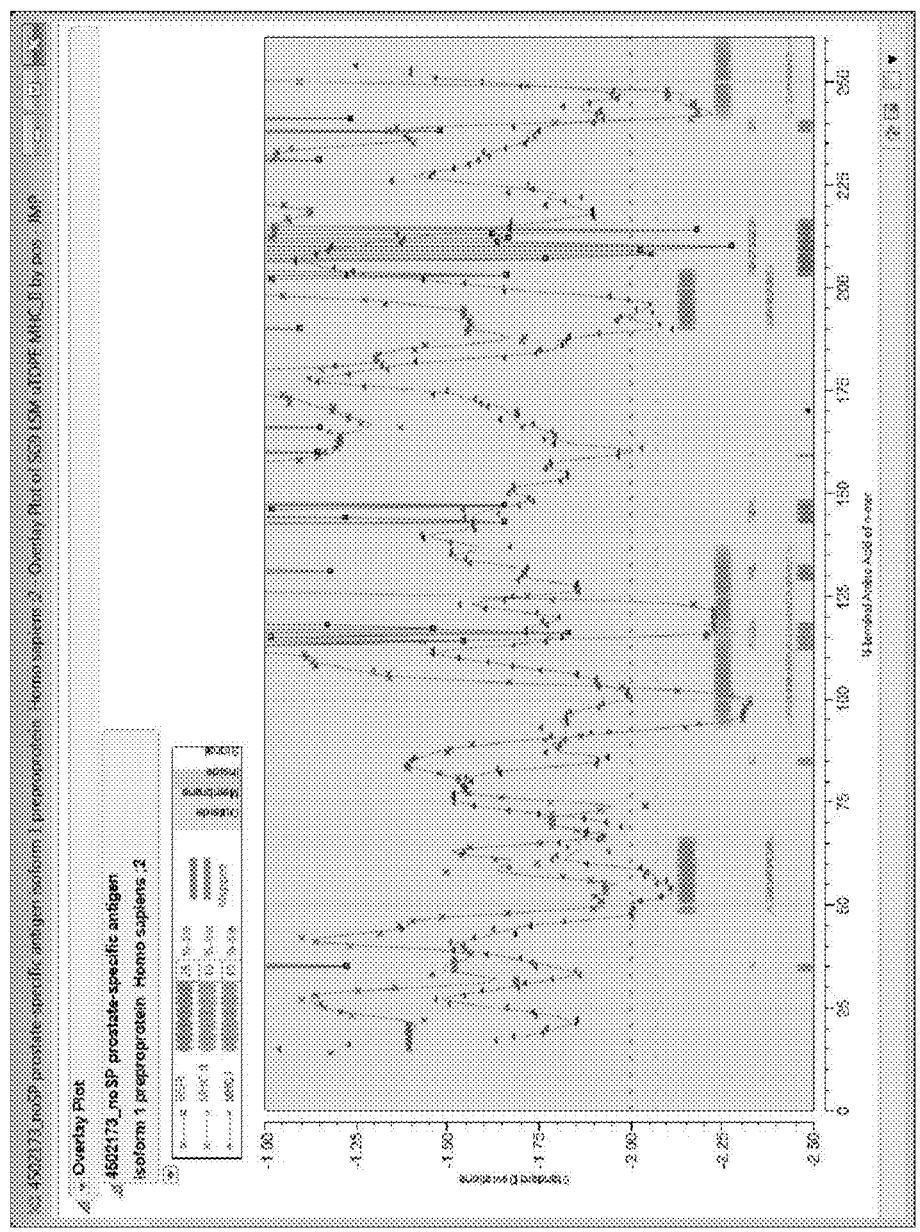
FIG. 10 shows the permuted population average binding affinity of peptides in the prostate specific antigen protein isoform 1 (PSA). This plot was made using the methods described herein. The 9 mer peptide starting at position 74 was selected for manipulation.
Figure 11:
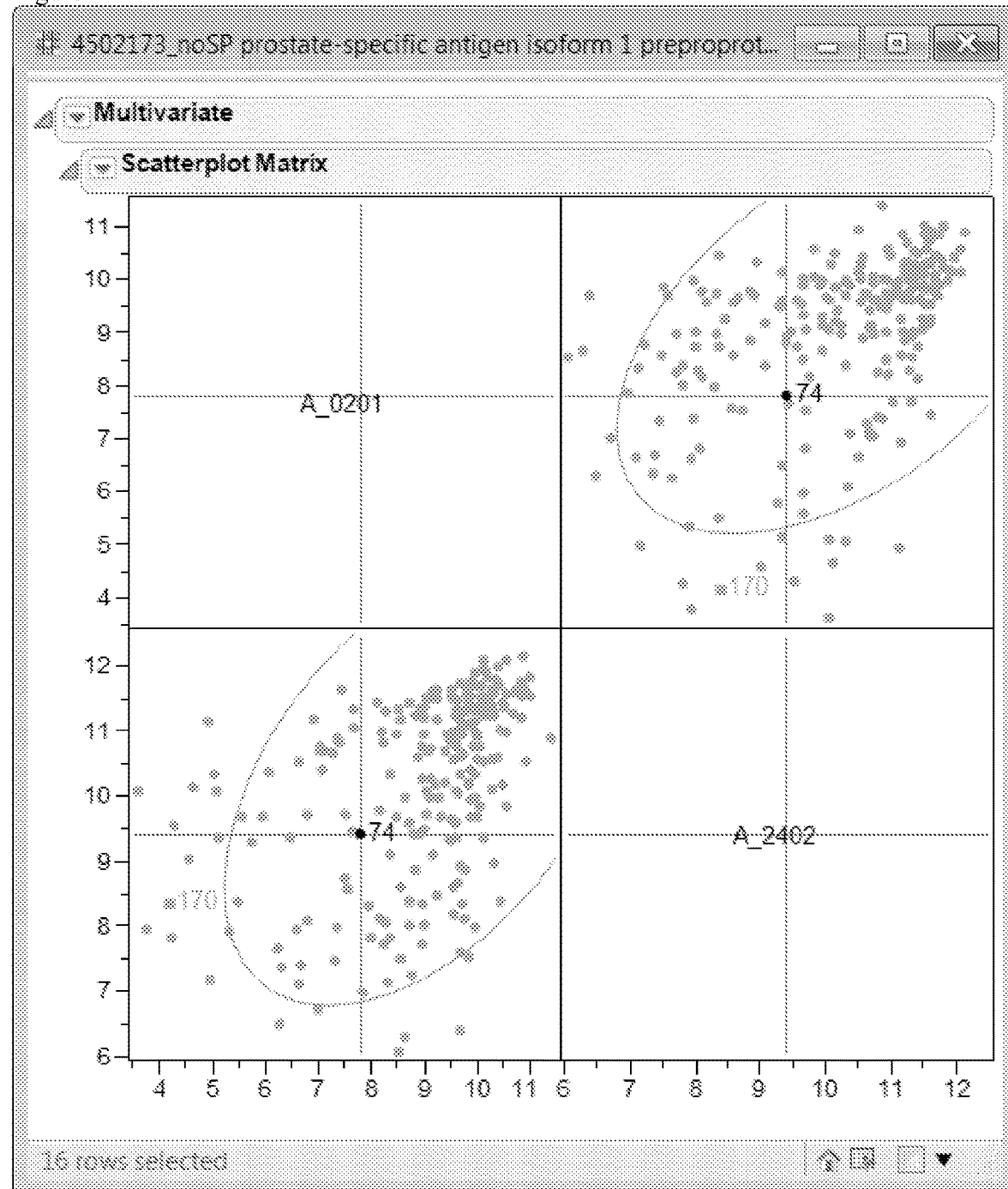
FIG. 11 shows the predicted binding affinity to MHC I alleles A_0201 and A_2402 of the 9 mer starting at position 74 in PSA relative to other 9mers in the parent protein. The intersection of the axes marks the binding affinity to both alleles. The gray dots are the affinities of all of the other peptides in the protein.
Figure 12:
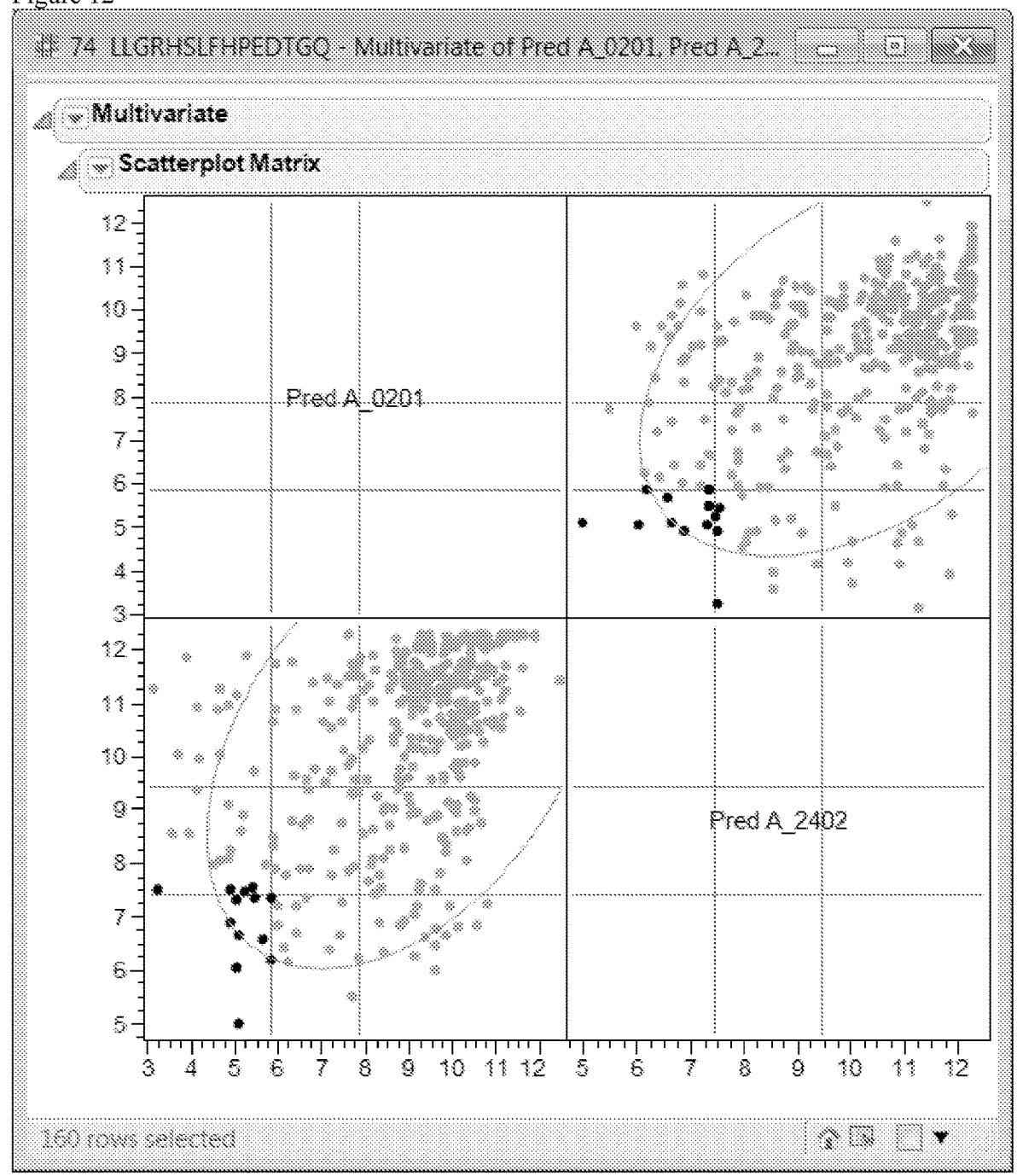
FIG. 12 shows the predicted binding affinity to MHC I alleles A_0201 and A_2402 of selected variants of the 9 mer starting at position 74 in PSA relative to other 9mers in the parent protein. The variants were the from among 5000 random combinations derived from the position 74 9 mer in which the core 5 mer was fixed and the two 2-mer flanking regions were varied to increase affinity. The selected peptides lie outside intersection of the axes marking the binding affinity to both alleles and have an $e^2$ (7.4 fold) increase in affinity.
Figure 13:
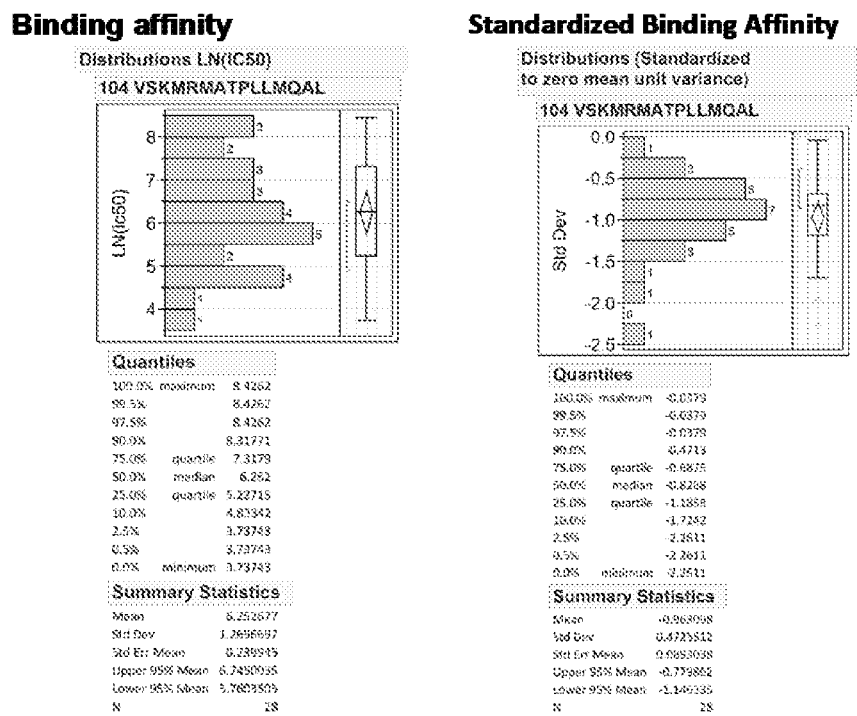
FIG. 13 shows the statistical characteristic of the primary CLIP peptide in the context of a canonical 15-mer for 28 human MHC II alleles. CLIP peptide binds to many different MHC II molecules with a moderate affinity of about e6.26=525 nM equivalent to about $-0.96\sigma$ (approx $-1\sigma$) below the mean.
Figure 14:
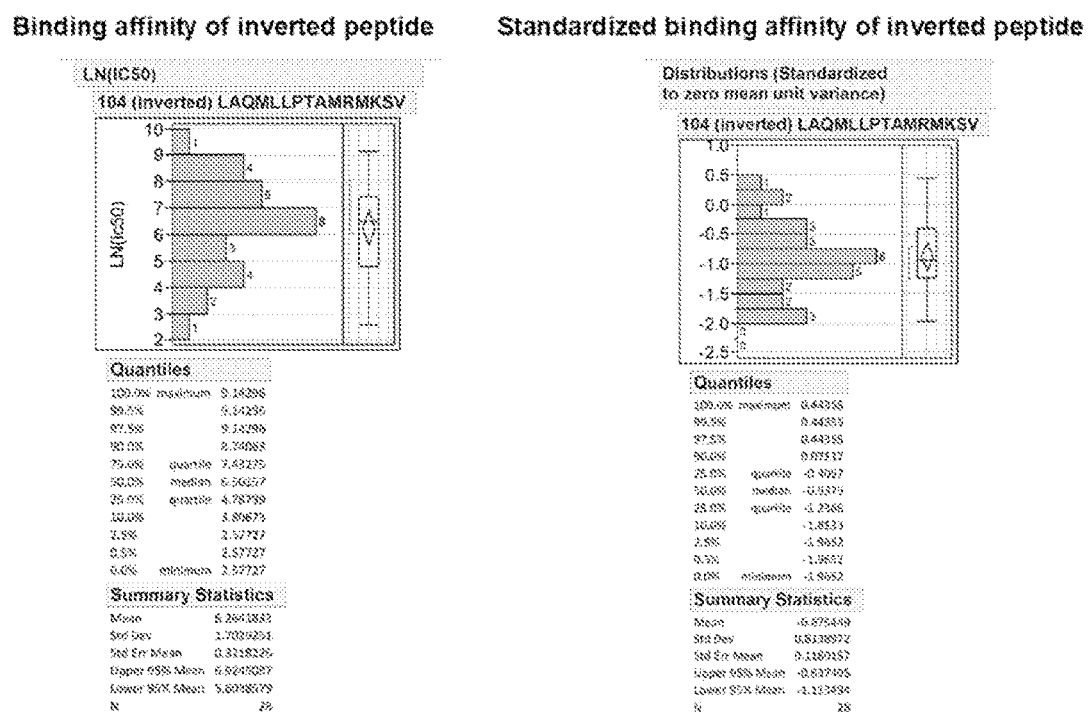
FIG. 14 shows the statistical characteristic of the inverted CLIP peptide in the context of an inverted (non-canonical) 15-mer for 28 human MHC II alleles.
Figure 16:
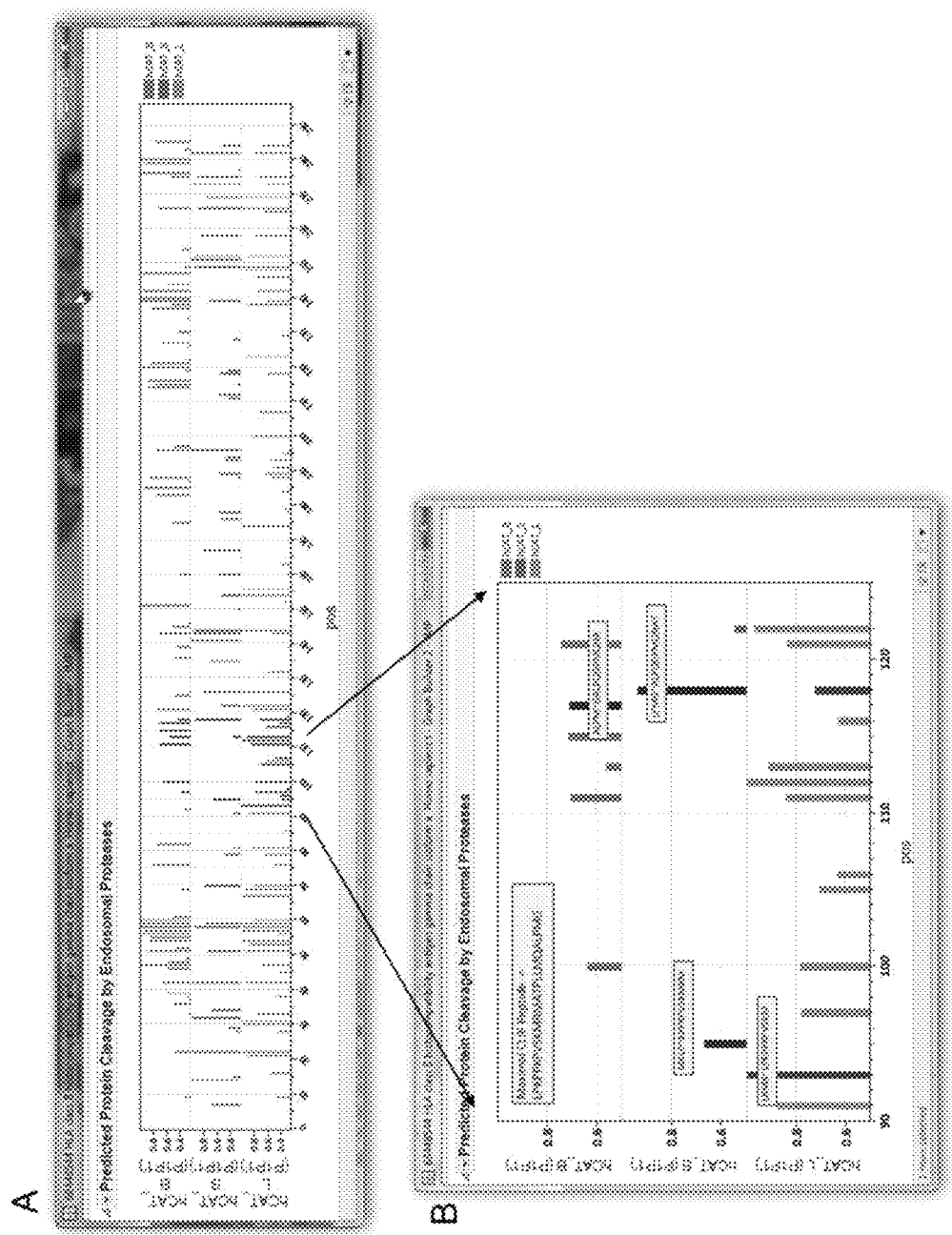
FIG. 16 shows the probability of cleavage by cathepsin B, S, L in HLA class II histocompatability antigen isoform A. Panel A shows the probability of cathepsin cleavage along the whole protein. Panel B expands the detail for amino acid positions 90-120. Highlighted (darker color bars) cleavage points are high yield promiscuous self peptides reported by Chicz et al 1993 (see Table 6 in reference) and shown in the inserted labels.

Maintaining the Core Sequence and Varying Flanking Regions to Increase Binding Affinity to One or More MHC-I Alleles of Interest In this example a 9 mer peptide was selected from prostate specific antigen. The goal was to increase the binding affinity simultaneously to two MHC 1 Alleles, A*0201 and A*2402. FIG. 10 shows the permuted plot of binding affinity within this protein. A 9 mer peptide starting at amino acid 74 was selected: LLGRHSLFH (SEQ ID NO: 28416). This was envisioned as a core (B) 5 mer and two flanking regions of 2 amino acids each. FIG. 11 shows the binding affinity to the alleles of interest of the native peptide 74. Variation of the two flanking regions provides a possible $20^4$ variants. A sample of 5000 variants yielded 396 unique variants of which 13 were shown to have an affinity of $e^2$ or more (i.e. 7.4 fold higher) than the native peptide 74. FIG. 12 shows the relative binding affinity of the resultant peptides to the alleles of interest.

Example 2

Treatment with Specific MHC Binding Peptides to Reduce Immune Reaction

Many biopharmaceutical proteins induce adverse or inhibitory acquired immune responses. By applying the analysis described herein it is possible to identify specific peptides that are highly antigenic for a specific group of HLAs. In some cases, when a T cell epitope is administered and presented as an immunogen in isolation and in increasing doses, in the absence of co-stimulatory stimuli, anergy may be induced. This is the approach taken in developing vaccines for allergens.

The array of predicted MHC binding affinity of all peptides within a biopharmaceutical of interest is identified. Specific peptides of predicted high affinity binding to specific MHC and therefore of high immunogenic potential for individuals of that immunogenetic allelic make-up are identified. These peptides are expressed as 9-mers, 15-mers or such peptides plus short flanking regions and administered to a patient prior to the administration of the biopharmaceutical from which they are derived. Typically such administration would be initiated 2-4 weeks prior to treatment with the biopharmaceutical and in multiple repeated doses with the intent of inducing anergy to the epitopes. However in some instances where a biopharmaceutical is administered to treat an acute disease (for example a sepsis) the peptides are administered at the same time as the biopharmaceutical.

In some instances the biopharmaceutical is an antibody or an antibody fusion. In other instances the biopharmaceutical is a replacement therapy (e.g., a blood clotting factor) of other protein drug. Additional peptides or polypeptides can be utilized with the compositions and methods described herein.

In some instances the native peptide is enhanced as an anergen by modifying the flanking regions of the MHC binding protein (amino acids 1-5 and 11-15 in the case of a MHC-II binding 15 mer or amino acids 1-2 and 8-9 in the case of a MHC-I binding 9-mer). Such modification is conducted by simulation of peptides with increased binding affinity to the MHC of alleles of interest and construction of the higher binding peptides.

Example 3

This Example provides additional epitope sequences developed by the processes of the present invention for *Brucella* species.

*Brucella* spp. are small, Gram negative bacteria which are intracellular and persist inside macrophages. Brucellosis has long been recognized in ruminant animals and swine and is a major cause of reproductive problems in livestock including abortions. *Brucella* bacteria are shed in milk and placental fluids and are highly infectious to humans. Species infecting domestic livestock are *B. melitensis* (goats and sheep), *B. suis* (pigs), *B. abortus* (cattle and bison), *B. ovis* (sheep), and *B. canis* (dogs). *B. abortus* also infects bison and elk in North America and *B. suis* is endemic in caribou. *Brucella* species have also been isolated from several marine mammal species.

Brucellosis, also called Bang's disease, Crimean fever, Gibraltar fever, Malta fever, Mediterranean fever, r, or undulant fever remains the most prevalent zoonosis worldwide (WHO/DFID-AHP Meeting with the participation of FAO and OIE. WHO/SDE/FOS/2006.1; Pappas G, et al (2006) The new global map of human brucellosis. Lancet Infect Dis 6: 91-99). Brucellosis is a debilitating chronic disease for those naturally infected through exposure to bacteria in milk and placental fluids of ruminant livestock (Corbel M J (1997) Brucellosis: an overview. Emerg Infect Dis 3: 213-221). As infection also occurs by inhalation of aerosols and the infective dose is low, *Brucella melitensis* is a potential bioterror agent with capacity to infect large numbers of people (Kaufmann A F, et al (1997) The economic impact of a bioterrorist attack: are prevention and post-attack intervention programs justifiable? Emerg Infect Dis 3: 83-94); less deadly but far more costly than an anthrax attack. *B. suis* has similar bioweapon potential. No effective vaccine exists to protect humans from brucellosis. Several weeks of antibiotic treatment are required, but may be unable to clear residual foci of bacteria. Historically, vaccines developed to control disease in cattle, sheep, and goats, the main natural reservoir of *B. melitensis*, comprise live attenuated *Brucella* organisms, still capable of causing disease in humans. Killed organisms are ineffective vaccines. DNA and subunit recombinant vaccines, offer potential safety, but have yet to provide long lasting protection or broad coverage. A safe and effective vaccine suitable for human use is needed to protect those facing occupational exposure, and to provide large scale protection and post-exposure intervention in the face of deployment of brucellosis as a bioterror weapon. Effective brucellosis vaccines would greatly benefit populations of highly endemic regions and would aid in reducing prevalence in the livestock reservoir.

The complete proteome sequences for multiple *Brucella* species were downloaded from patricbrc.org or Genbank and analyzed according to the methods described herein. The 54 species analyzed are shown in Table 17.

TABLE 17

Species and strains of *Brucella melitensis*, *B.suis* and *B.abortus* analyzed

| Genome Name | Genome Status | PATRIC CDS | Isolation Country | Host Name | Collection Date |
|---|---|---|---|---|---|
| *Brucella abortus* 104M | WGS | 3303 | China | | |
| *Brucella abortus* A13334 | Complete | 3308 | South Korea | cattle | |
| *Brucella abortus* NCTC 8038 | WGS | 3439 | | | |
| *Brucella abortus* S19 | Complete | 3476 | | | 1923 |
| *Brucella abortus* bv. 1 str. 134 | WGS | 3298 | China | Homo sapiens | 2001 |
| *Brucella abortus* bv. 1 str. 9-941 | Complete | 3476 | | | |
| *Brucella abortus* bv. 1 str. BCB013 | WGS | 3255 | China | Bos taurus | 2010 |
| *Brucella abortus* bv. 1 str. BCB027 | WGS | 3203 | China | Ovis aries | 1983 |
| *Brucella abortus* bv. 1 str. NI010 | WGS | 3301 | | | |
| *Brucella abortus* bv. 1 str. NI016 | WGS | 3307 | | | |
| *Brucella abortus* bv. 1 str. NI021 | WGS | 3304 | | | |
| *Brucella abortus* bv. 1 str. NI259 | WGS | 3314 | | | |
| *Brucella abortus* bv. 1 str. NI435a | WGS | 3300 | | | |
| *Brucella abortus* bv. 1 str. NI474 | WGS | 3309 | | | |
| *Brucella abortus* bv. 1 str. NI486 | WGS | 3309 | | | |
| *Brucella abortus* bv. 1 str. NI488 | WGS | 3297 | | | |
| *Brucella abortus* bv. 2 str. 86/8/59 | WGS | 3574 | | bovine | 1959 |
| *Brucella abortus* bv. 2 str. BCB034 | WGS | 3305 | China | Homo sapiens | 2000 |
| *Brucella abortus* bv. 3 str. Tulya | WGS | 3521 | | | |
| *Brucella abortus* bv. 4 str. 292 | WGS | 3429 | | bovine | 1960 |
| *Brucella abortus* bv. 5 str. B3196 | WGS | 3473 | | | |
| *Brucella abortus* bv. 6 str. 870 | WGS | 3435 | | | |
| *Brucella abortus* bv. 9 str. C68 | WGS | 3406 | | | |
| *Brucella abortus* str. 2308 A | WGS | 3473 | | | |
| *Brucella melitensis* 16M13W | WGS | 3283 | | | |
| *Brucella melitensis* 16M1W | WGS | 3312 | | | |
| *Brucella melitensis* ATCC 23457 | Complete | 3486 | | Homo sapiens | |
| *Brucella melitensis* M28 | Complete | 3366 | | | |
| *Brucella melitensis* M5-10 | WGS | 3350 | China | | |
| *Brucella melitensis* M5-90 | Complete | 3347 | | | |
| *Brucella melitensis* NI | Complete | 3321 | China | cattle | |
| *Brucella melitensis* biovar Abortus 2308 | Complete | 3467 | | | |
| *Brucella melitensis* bv. 1 str. 133 | WGS | 3327 | China | Homo sapiens | 1998 |
| *Brucella melitensis* bv. 1 str. 16M | Complete | 3499 | | Homo sapiens | |
| *Brucella melitensis* bv. 1 str. 16M [WGS] | WGS | 3538 | | | |
| *Brucella melitensis* bv. 1 str. BCB028 | WGS | 3335 | China | Ovis aries | 1956 |
| *Brucella melitensis* bv. 1 str. BCB033 | WGS | 3346 | China | Homo sapiens | 2006 |
| *Brucella melitensis* bv. 1 str. M111 | WGS | 3331 | | | |
| *Brucella melitensis* bv. 1 str. M28-12 | WGS | 3331 | China | sheep | |
| *Brucella melitensis* bv. 1 str. M5 | WGS | 3335 | | | |
| *Brucella melitensis* bv. 1 str. Rev.1 | WGS | 3440 | | | |
| *Brucella melitensis* bv. 2 str. 63/9 | WGS | 3447 | | | |
| *Brucella melitensis* bv. 3 str. 128 | WGS | 3347 | China | Homo sapiens | 1986 |
| *Brucella melitensis* bv. 3 str. Ether | WGS | 3457 | | | |
| *Brucella suis* 1330 | Complete | 3432 | | swine | |
| *Brucella suis* ATCC 23445 | Complete | 3591 | | | |
| *Brucella suis* S2-30 | WGS | 3335 | China | | |
| *Brucella suis* VBI22 | Complete | 3292 | | | |
| *Brucella suis* bv. 1 str. BCB025 | WGS | 3223 | China | Sus scrofa | 2001 |
| *Brucella suis* bv. 1 str. S2 | WGS | 3289 | | | |
| *Brucella suis* bv. 2 str. BCB032 | WGS | 3272 | China | Sus scrofa | 2008 |
| *Brucella suis* bv. 3 str. 686 | WGS | 3515 | | | |
| *Brucella suis* bv. 4 str. 40 | WGS | 3388 | Soviet Union | reindeer | |
| *Brucella suis* bv. 5 str. 513 | WGS | 3377 | | | | bv = biovar
str = strain

A determination was made of the proteins which are conserved or near conserved across these species. Protein sequences were selected using 2 criteria (a) those contained in Figfams present in all 54 strains and which were represented in the *B. melitensis* 16M reference strain by a single representative; (b) an additional group of 7 proteins which had been previously identified by experimental means to induce interferon gamma and which were not present in group (a).

High affinity MHC-I and MHC-II binding peptides and high probability B-cell epitope sequences were determined.

MHC I and MHC II binding data were first standardized to zero mean and unit variance and then for each peptide in the protein sequence the highest binding affinity of combinations of allelic pairs was computed. Finally all possible combinations of alleles were averaged to represent a population phenotype for each particular peptide in the protein sequence. The population-permuted metric over protein sequences was found to be normally distributed and the peptides selected covered regions within the proteins of predicted highest affinity within that protein—the tenth percentile and one percentile highest affinity peptides. BEPI regions were selected based on the 25th percentile Bayesian probability for predicted B-cell epitopes based on a NN predictor trained with a large dataset of BepiPred 1.0 output for 100 randomly selected proteins.

The following table summarizes the output: Table 18 shows the number of peptides identified which fulfill the criteria established.

TABLE 18

| Species | Class | Type | First SEQ number | Last SEQ number | Number |
|---|---|---|---|---|---|
| *Brucella* spp | Membrane | BEPI | 1 | 335 | 335 |
| | | MHC_I | 336 | 537 | 202 |
| | | MHC_I_top 1% | 538 | 563 | 26 |
| | | MHC_II | 564 | 676 | 113 |
| | | MHC_II_top 1% | 677 | 690 | 14 |
| | Other | BEPI | 691 | 14805 | 14115 |
| | | MHC_I | 14806 | 22134 | 7329 |
| | | MHC_I_top 1% | 22135 | 23080 | 946 |
| | | MHC_II | 23081 | 27439 | 4359 |
| | | MHC_II_top 1% | 27440 | 27857 | 418 |
| | Secreted | BEPI | 27858 | 28153 | 296 |
| | | MHC_I | 28154 | 28299 | 146 |
| | | MHC_I_top 1% | 28300 | 28314 | 15 |
| | | MHC_II | 28315 | 28398 | 84 |
| | | MHC_II_top 1% | 28399 | 28404 | 6 |

Example 4

Binding Characteristics and Cleavage of the CLIP Peptides

The "CLIP" peptide (MHC Class II invariant peptide) is produced by endosomal cleavage of the MHC gamma, also known as the "invariant chain". The MHC-gamma allele is one of the genes in the MHC locus and has substantial structural similarity to the MHC molecules. It appears to have two purposes: First, a portion of the molecule binds in the molecular groove of the MHC II molecule and is used as a chaperone for guiding the MHC II molecule in the endosomal compartment where peptide loading takes place. Second, the CLIP peptide when released by endosomal peptidase activity, binds only with a moderate binding affinity to many different MHC II alleles and serves as a placeholder for other peptides that will be loaded into the MHC molecule in its place with the assistance of MHC-DM for ultimate presentation on the surface of the antigen presenting cell.

Experimental evidence shows that the so-called "CLIP peptide" is not a single peptide but actually a group of peptides with slightly different lengths (ragged ends) produced by differential endosomal peptidase cleavage activity. The longest of these peptides has the sequence LPKPPKPVSKMRMATPLLMQALPMG ((SEQ ID NO: 28417). The underlined sequence has been shown in experiments by others (Chicz R M et al, 1993 J Exp Med., Specificity and Promiscuity among Naturally Processed Peptides Bound to HLA-DR Alleles; Villadangos, J A et at 1997, J Exp Med, Degradation of Mouse Invariant Chain: Roles of Cathepsins S and D and the Influence of Major Histocompatability Complex Polymorphism) to be the primary binding region. It has the characteristic of binding to many different MHC II molecules (so is sometimes called a promiscuous peptide) with what is generally considered a moderate affinity of about e6.26=525 nM equivalent to about −0.96σ (approx −1σ) below the mean (FIG. 13). In fact, the neural net (NN) predictions suggest that several different binding registers will bind with a very similar binding affinity (IC50). An interesting feature of this molecule was determined recently where new experiments (Schlundt, A. 2012, J Mol. Biol Peptide Linkage to the alpha Subunit of MHC II Creates a Stably Inverted Antigen Presentation Complex) suggest that the peptide can bind, not only in the standard or canonical N ◇ C orientation, but also in the reverse C ◇ N orientation. Interestingly, the NN predictions for binding of the reverse peptide are also very comparable to the canonical orientation. As can be seen in FIG. 14, for several binding registers the affinity is actually higher for the inverted orientation that the canonical. A caveat to this observation is that the experimental procedures that are used to estimate the binding affinity to an MHC molecule are a bulk measurement done without knowledge of which orientation the peptides are assuming. It could be that the molecule assumes N ◇ C orientation or a C ◇ N or a mixture of the two. FIG. 15 shows the predicted binding affinity in several different binding registers for the canonical and inverted peptide orientation for a single common human MHC II allele (DRB1*01:01). The results are typical of those we have seen for the other 27 human alleles, as well as those from other species such as the mouse.

It follows that peptides from proteins of other derivations (including but not limited to microbial, mammalian, insect, allergen, etc.) may also be bound to MHC molecules in canonical or non-canonical orientation and thus may be presented by MHC as T cell epitopes in either orientation.

Furthermore, with reference to CLIP, the experimental determinations (Chicz et at vide infra) of peptide presentation by MHC molecules on antigen presenting cells provided a system for independent verification of the cathepsin cleavage predictions. The peptides presented on the MHC molecules at the cell surface should have been excised by the endosomal peptidases. Therefore the NN cleavage predictions for the endosomal peptidases, cathepsin B, L and S were compared to the N and C termini of the presented peptides. The cleavage predictions were found to be highly concordant with peptides attached to MHC II molecules and which had been detected by mass spectrometry. The endosomal peptidases are quite aggressive enzymes and cleave at a wide variety of amino acid sequences. Consistent with this, several different cleavage positions are predicted in this vicinity of the CLIP peptide molecule. The median length of peptide eluted and detected by mass spectrometry is 17 amino acids or two amino acids longer than the 15-mer binding pocket in the MHC II molecule generally recognized. The results of this Comparison are shown in FIG. 16. The experiments were carried out with virus transformed human B cells and in this cell type cathepsin S is thought to be the predominant endopeptidase activity. The primary eluted peptide (MRMATPLLMQALPM (SEQ ID NO: 28418) can be seen in FIG. 16 to be bracketed by the cathepsin S cleavage on both the N- and C-termini.

In addition to the invariant chain several additional peptides were also found loaded into the MHC II molecule (Chicz et al, vide infra). These peptides had "ragged" ends extending several amino acids in both the N-terminal and C-terminal side of the binding pocket. In each case the cleavage predictions matched the peptides that were detected.

The experiments described above with reference to CLIP showed a critical relationship between cathepsin cleavage and MHC presentation. The observations with MHC II were extended and shown to also be consistent with observations with respect to MHC I presentation of the shorter 9-mer peptides. Peptides presented on cell surfaces bound to MHC I molecules arise via proteasomal cleavages of protein molecules tagged for destruction in the cytoplasm. Resulting fragments produced in this part of the process are longer (up to about 20-mers) than can be accommodated in the binding pocket of MHC I molecules. These fragments are delivered to the MHC loading compartment by specialized molecular machinery called TAP (transporter associated antigen processing) where the resident peptidases trim the peptides to fit into the binding groove.

Example 5

Binding Characteristics and Cleavage of *Brucella melitensis* Methionine Sulphoxide Reductase A 9-mer peptide, RYCINSASL (SEQ ID NO: 28419) (RL9) from *Brucella melitensis* methionine sulphoxide reductase B has been found to be presented on MHC I molecules and produce populations of T-cells which recognize the pMHC complex (Durward, M. et al 2010 Infection and Immunity Discordant *Brucella melitensis* Antigens Yield Cognate CD8 T Cells In Vivo).

Figure 17:
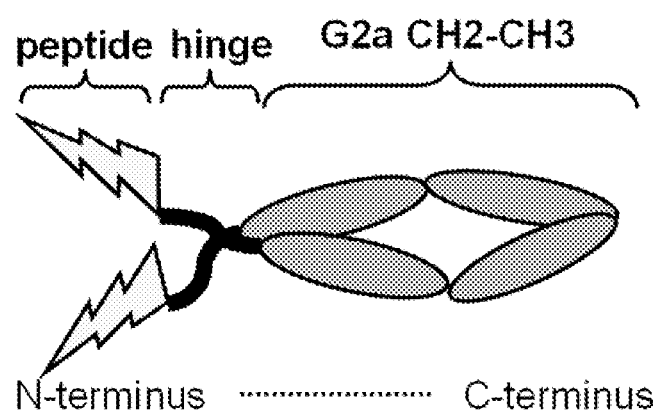
FIG. 17 shows a construct comprising an epitope peptide of interest at the N-terminus, the hinge region and the constant regions CH2 and CH3 from the murine IgG2a immunoglobulin. The molecule dimerizes via formation of disulphide bonds at the hinge.
Figure 18:
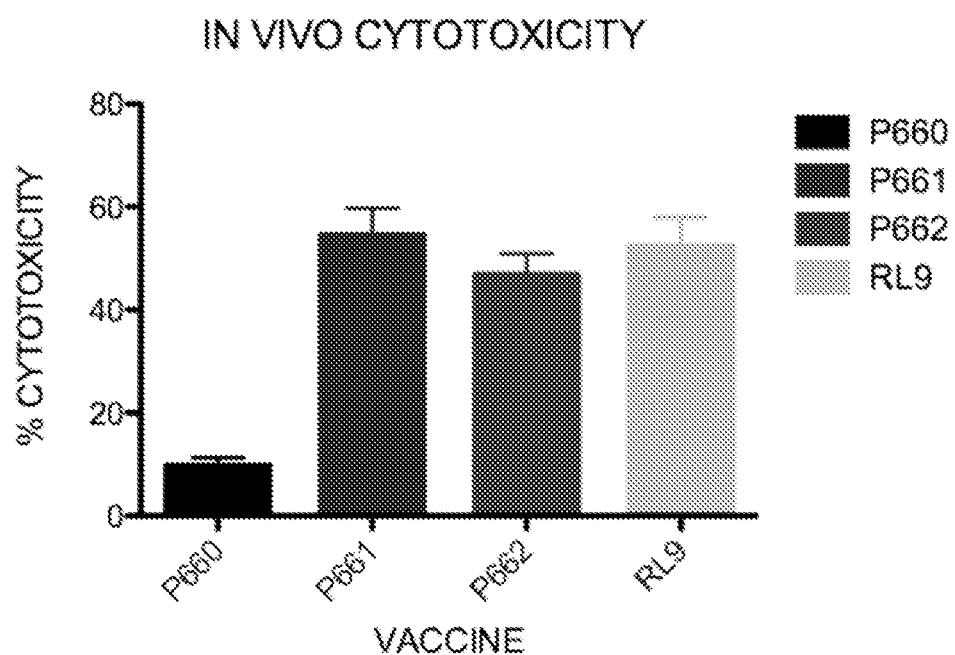
FIG. 18 shows the in vivo clearance of RL9 pulsed splenocytes in immunized mice. Mice were immunized and boosted once with affinity-purified RL-G2a(CH2-CH3) (P661) or RL-G2a(CH2-CH3)-RL (P662) or synthetic peptide RL9. One week after the boost, RL9-pulsed (labeled CFSEhi) and unpulsed (labeled CFSElo) splenocytes from naïve mice were adoptively transferred into the immunized mice via retrobulbar injection. Six hours post transfer, spleens were removed from immunized mice and analyzed for surviving pulsed, labeled target cells using flow cytometry. % specific lysis=1−[naive/vaccinated]×100; where r=% CFSELo cells÷% CFSEHi cells. P660=immunized with isotype-matching, irrelevant antibody.

Further to the studies published by Durward et at we showed that immunization of mice with the RL9 peptide leads to a protective response pattern in mice. We produced two versions of the RL-G2aFc molecule shown in FIG. 17, one with an N-terminal peptide fusion, the other with both N-terminal and C-terminal peptide fusions. Mice were immunized to test the two carrier proteins carrying known effective peptide (RL9). Mice immunized with the RL-G2a (CH2-CH3) or RL-G2a(CH2-CH3)-RL construct were able to reduce the number of RL9-pulsed target cells at a significantly higher rate than control immunized mice (FIG. 18) indicating that RL-G2a(CH2-CH3) vaccine induces a cellular cytotoxic response against target splenocytes displaying RL9 peptide, consistent with the protective response pattern known to eliminate *Brucella* infection. The data show the G2a(CH2-CH-3) carrier protein bearing the larger CEG peptide is correctly cleaved and RL9 peptide specific effector cells are created.

In view of the observations of the critical role of cathepsin cleavage in presentation of CLIP peptides, described in the Example 5 above, an experiment was designed to further examine the role of cathepsin in epitope definition.

Figure 19:
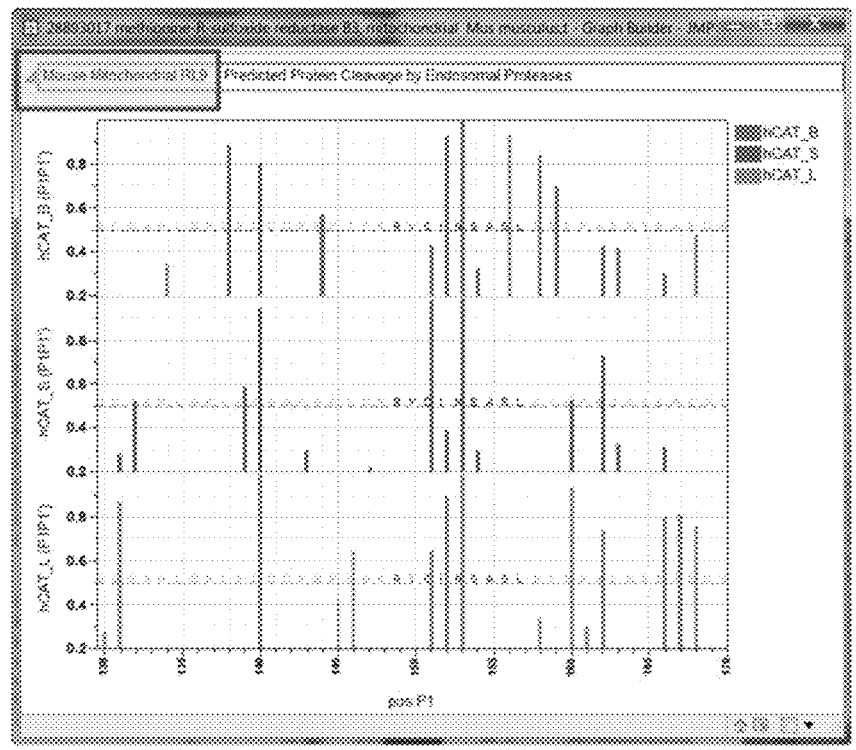
FIG. 19 shows the probability of cathepsin cleavage in methionine sulphoxide reductase B. Panel A shows the predicted cleavage of murine methionine sulphoxide reductase B. Panel B shows the probability of cleavage of Brucella melitensis methionine sulphoxide reductase B. In both panels the 9 mer peptide of interest RYCINSASL is shown.
Figure 19:
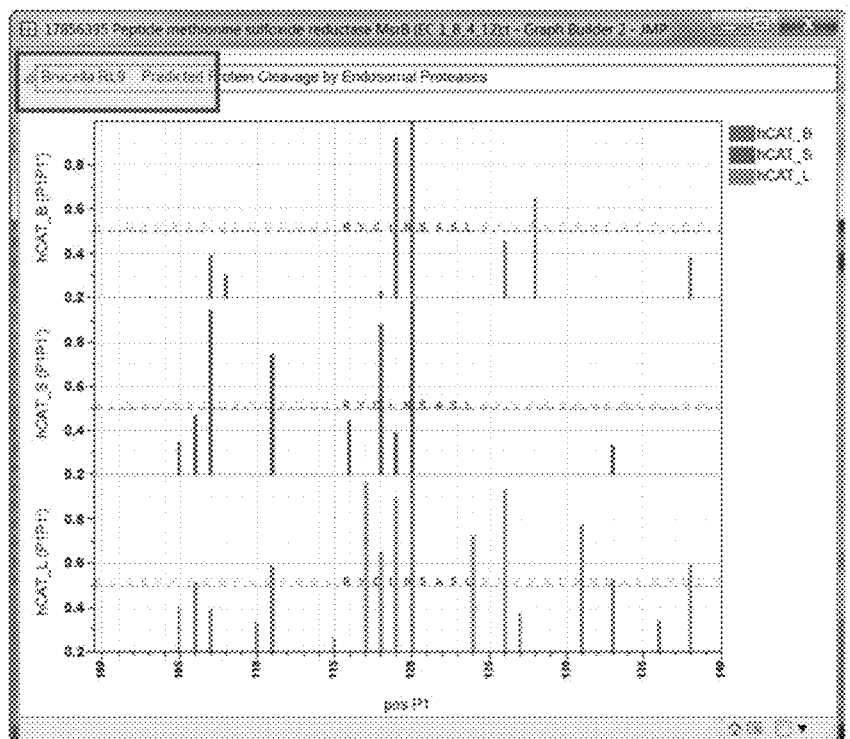

An interesting feature of the peptide identified, RYCINSASL (SEQ ID NO: 28419), is that it is derived from the active site of a metabolic enzyme widely distributed in nature. Mice contain the identical 9-mer peptide in their mitochondrial version of the enzyme. Thus, it would be expected that the mice would recognize the RYCINSASL (SEQ ID NO: 28419) peptide as "self" and not produce an immunological response. Nevertheless, mice infected with *B. melitensis* produce a profound immunological response to this peptide; it is not recognized as self. We noted that the flanking residues outside of the active site 9-mer are quite different between the murine endogenous and *B. melitensis* forms of the enzyme. The differences in amino acids in the flanking positions change the probability of the N- and C-terminal bonds being cleaved. In contrast to the peptide from *B. melitensis*, the peptide in the mouse mitochondrial enzyme is not predicted to be excised (FIG. 19).

In order to test this experimentally we replaced 6 amino acids on the N- and C-terminal side of the RL9 peptide in the *Brucella* enzyme to make it non-cleavable. This is shown in FIG. 20.

Cloning of *Brucella* RL(105-135) Peptides into mG2a Carrier

Existing wild-type *Brucella* RL(105-135) peptide cloned into p500695. The wt *Brucella* amino acid sequence contains cathepsin S cleavage sites upstream of the RL9 peptide as shown in SEQ ID NOS: 28412 and 28413.

Modified *Brucella* RL(105-135)mod peptide was cloned into mG2a carrier, this sequence has the RL9 flanking regions from *Brucella* replaced with murine flanking regions that are predicted to have no cathepsin S cleavage sites, the two flanking regions are marked in SEQ ID Nos.: 28415 AND 28416 and in FIG. 20.

Cloning procedure: The amino acid sequence encoding *Brucella melitensis* methionine sulfoxide reductase (Accession #NP_541797) position aa 105-135 was backtranslated using the Lasergene software (DNAstar, Madison, WI) built-in mammalian non-degenerate backtranslation code. Proper restriction enzyme sites were added to both ends of the RL(105-135) sequence and the nucleotide sequence was synthesized using a commercial vendor (IDT, Coralville, IA). The sequence for the modified RL(105-135)mod was similarly assembled in silico and then submitted for synthesis. The obtained synthesized RL(15-135) gene sequences are digested with the specific restriction sites and in-frame cloned upstream of the murine G2a (hinge-CH2-CH3)-containing retroviral expression retrovector.

In vivo testing: The expression retrovectors containing the RL(105-135) or RL(105-135)mod sequence were used to make stable CHO expression cell lines to produce both peptides as N-terminal murine IgG2a hinge-Fc portion. BR-RL(105-135)-mG2a and BR-RL(105-135)mod-mG2a is harvested from cell supernatant and used to immunize mice via subcutaneous injection at the tail at 25 ug/mouse dose and formulated with Sigma (S6322) and CpG adjuvants. One or two boosts are given after the first injection. One week after the last boost, splenocytes are collected from immunized mice and cultivated in vitro. Splenocytes from naïve mice are pulsed with synthesized RL9 or irrelevant control peptide and then added to the harvested effector cells. After a 5 h incubation, cells are harvested and monitored for T-cell phenotype (CD4, CD8, CD3), activation status (LFA-1) and intracellular cytokine (INFg) production using flow cytometry. This analysis will yield information as to whether the removal of a predicted cathepsin cleavage site changes processing of peptides upon uptake by antigen presenting cells and subsequent stimulation of T-cells.

It is anticipated that mice vaccinated with the modified peptide sequence will not display the peptide on the MHC I surface molecules nor generate a T-cell response.

Seq 1. BR-RL(105-135)-G2a(CH2-CH3)-BR-RL,
nucleotide sequence, ID:500695n (SEQ ID NO: 28420)
TTCCCCGACGGCCCCGTGGACCGCGGCGGCCTGCGCTACTGCATCAACT
CCGCCTCCCTGCGCTTCGTGCCCAAGGACCGCATGGAGGCCGAG -continued

```
1-93 BR-RL(105-135)
Seq. 2. BR-RL(105-135)-G2a(CH2-CH3)-BR-RL, amino
acid sequence, ID:500695p
                                    (SEQ ID NO: 28421)
FPDGPVDRGGLRYCINSASLRFVPKDRMEAE Seq. 3. BR-RL(105-135)mod-G2a(CH2-CH3)-BR-RL,
nucleotide sequence, ID:500695n
                                    (SEQ ID NO: 28422)
TTCCCCGACGGCCCTCCTCGTCCGACCGGCAAAAGATACTGCATCAACT
CAGCATCCTTGTCCTTCACTCCTGCAGACCGCATGGAGGCCGAG
```

| | |
|---|---|
| 1-15 | *Brucella* sequence |
| 16-33 | Murine sequence |
| 34-60 | *Brucella* RL9 peptide |
| 61-78 | Murine sequence |
| *79-93* | *Brucella sequence* |

```
Seq. 4. BR-RL(105-135)mod-G2a(CH2-CH3)-BR-RL,
amino acid sequence, ID:500695p
                                    (SEQ ID NO: 28423)
FPDGPPRPTGKRYCINSASLSFTPADRMEAE
```

| | |
|---|---|
| 1-5 | *Brucella* sequence |
| 6-11 | Murine sequence |
| 12-20 | *Brucella* RL9 peptide |
| 21-26 | Murine sequence |
| 27-31 | *Brucella* sequence |

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in the relevant fields are intended to be within the scope of the following claims.

The invention claimed is:

1. A process of identifying variant cancer cell epitopes that bind to an MHC binding region and producing a vaccine comprising:

a) obtaining amino acid sequences for a cancer cell protein;

b) providing peptide binding prediction equations for multiple MHC binding regions derived by:

(i) assembling experimentally derived data comprising a multiplicity of measurements of amino acid physicochemical properties;

(ii) producing a correlation matrix of the experimentally derived data;

(iii) deriving by Principal Component Analysis multiple uncorrelated dimensionless, weighted and ranked proxy descriptors to describe at least 80% of the variance in said physicochemical properties of individual amino acids, (iv) using said proxy descriptors to describe individual amino acids in peptides with known binding affinities thereby creating vectors which describe said peptides with known binding affinities, and (v) via neural network modeling, deriving said binding prediction equations by comparing said vectors with said known binding affinities of said peptides;

(c) in-putting said amino acid sequences from said cancer cell protein into a computer;

(d) identifying peptides of interest in said cancer cell protein, wherein the peptides of interest are suspected cancer cell epitopes, and determining the binding affinity of the peptides of interest by applying the MHC binding prediction equations;

(e) generating in silico at least 1000 variants of the peptides of interest by substituting individual amino acids of the peptides with a different amino acid;

(f) applying proxy descriptors derived from the Principal Component Analysis of step (b) to describe each of the variant peptides generated in step (e) and applying the MHC binding prediction equations of step (b) to each of the variant peptides to determine the predicted MHC binding of each variant peptide;

(g) comparing the predicted binding to an MHC binding region of each of the variant peptides generated in step (e) with the binding affinity of the peptides of interest in the cancer protein to identify variant peptide sequences with higher or lower predicted binding affinity to said MHC binding region;

(h) synthesizing one or more of said variant peptide sequences which are identified as having a higher or lower predicted binding affinity to said MHC binding region;

(i) formulating the synthesized peptides with a pharmaceutical carrier to provide a vaccine, and (j) administering the vaccine to a subject that has cancer under conditions such that an immune response is generated.

2. The process of claim 1 wherein said synthesized peptide is identified as having higher or lower binding affinity to more than one binding partner.

SEQUENCE LISTING (28423 sequences)

SEQ ID NO: 1 - protein, 9 aa, Brucella spp.
AQPGSVTSE

SEQ ID NO: 2 - protein, 6 aa, Brucella spp.
RNMSSA

SEQ ID NO: 3 - protein, 10 aa, Brucella spp.
GSETALTAAS

SEQ ID NO: 4 - protein, 6 aa, Brucella spp.
HGDARA

SEQ ID NO: 5 - protein, 6 aa, Brucella spp.
ISSPDR

SEQ ID NO: 6 - protein, 7 aa, Brucella spp.
SPQEELR

SEQ ID NO: 7 - protein, 9 aa, Brucella spp.
IKEDRDQLG

SEQ ID NO: 8 - protein, 8 aa, Brucella spp.
NADTPADQ

SEQ ID NO: 9 - protein, 5 aa, Brucella spp.
TTLQD

SEQ ID NO: 10 - protein, 4 aa, Brucella spp.
SDEH

SEQ ID NO: 11 - protein, 8 aa, Brucella spp.
LQPDGSAI

SEQ ID NO: 12 - protein, 7 aa, Brucella spp.
PDEEATT

SEQ ID NO: 13 - protein, 5 aa, Brucella spp.
QTIPE

SEQ ID NO: 14 - protein, 5 aa, Brucella spp.
EKNRL

SEQ ID NO: 15 - protein, 14 aa, Brucella spp.
ADGKPAQISAAGRA

SEQ ID NO: 16 - protein, 7 aa, Brucella spp.
RRFGPAA

SEQ ID NO: 17 - protein, 5 aa, Brucella spp.
LAEPA

SEQ ID NO: 18 - protein, 4 aa, Brucella spp.
SGGH

SEQ ID NO: 19 - protein, 23 aa, Brucella spp.
GKDGFSAGGLASNGYGELSPGGY

SEQ ID NO: 20 - protein, 8 aa, Brucella spp.
TSSLAPAG

SEQ ID NO: 21 - protein, 6 aa, Brucella spp.
PARSTG

SEQ ID NO: 22 - protein, 18 aa, Brucella spp.
RRRRQGPSPIVPDGSVTG

SEQ ID NO: 23 - protein, 14 aa, Brucella spp.
EGQDIEQELQQASE

SEQ ID NO: 24 - protein, 4 aa, Brucella spp.
EATA

SEQ ID NO: 25 - protein, 8 aa, Brucella spp.
ENAPPDFE

SEQ ID NO: 26 - protein, 7 aa, Brucella spp.
GAMSGNG

SEQ ID NO: 27 - protein, 9 aa, Brucella spp.
ATPEGDQAA

SEQ ID NO: 28 - protein, 5 aa, Brucella spp.
SDGYL

SEQ ID NO: 29 - protein, 7 aa, Brucella spp.
EAKARAD

SEQ ID NO: 30 - protein, 6 aa, Brucella spp.
QRPSEG

SEQ ID NO: 31 - protein, 9 aa, Brucella spp.
KFSSGSPLY

SEQ ID NO: 32 - protein, 4 aa, Brucella spp.
TSNT

SEQ ID NO: 33 - protein, 11 aa, Brucella spp.
RTEPTKTEPLS

SEQ ID NO: 34 - protein, 4 aa, Brucella spp.
DGST

SEQ ID NO: 35 - protein, 9 aa, Brucella spp.
NAKSPELDG

SEQ ID NO: 36 - protein, 8 aa, Brucella spp.
LASDSESV

SEQ ID NO: 37 - protein, 6 aa, Brucella spp.
GHSGTI

SEQ ID NO: 38 - protein, 6 aa, Brucella spp.
SLAQAG

SEQ ID NO: 39 - protein, 6 aa, Brucella spp.
PAQGGN

SEQ ID NO: 40 - protein, 10 aa, Brucella spp.
PKDENGNPTM

SEQ ID NO: 41 - protein, 17 aa, Brucella spp.
KGKASAGFIPLGRLPAL

SEQ ID NO: 42 - protein, 5 aa, Brucella spp.
PRAAR

SEQ ID NO: 43 - protein, 5 aa, Brucella spp.
PPREE

SEQ ID NO: 44 - protein, 10 aa, Brucella spp.
TGTMATGTHD

SEQ ID NO: 45 - protein, 14 aa, Brucella spp.
QSGLPRPRVPERDP

SEQ ID NO: 46 - protein, 8 aa, Brucella spp.
LGSTSGRI

SEQ ID NO: 47 - protein, 9 aa, Brucella spp.
LPPAKGSAV

SEQ ID NO: 48 - protein, 6 aa, Brucella spp.
PPRYTG

SEQ ID NO: 49 - protein, 15 aa, Brucella spp.
GSENRKAADPITVPQ

SEQ ID NO: 50 - protein, 19 aa, Brucella spp.
GSAERLTATDAEGKRREIK

SEQ ID NO: 51 - protein, 23 aa, Brucella spp.
VAARQGEKAEEGPIDSSVDGSRN

SEQ ID NO: 52 - protein, 4 aa, Brucella spp.
DETL

SEQ ID NO: 53 - protein, 7 aa, Brucella spp.
PDNPPTI

SEQ ID NO: 54 - protein, 8 aa, Brucella spp.
KEPERALN

SEQ ID NO: 55 - protein, 10 aa, Brucella spp.
DDYGAAKAEA

SEQ ID NO: 56 - protein, 12 aa, Brucella spp.
TGDEEEEADPLY

SEQ ID NO: 57 - protein, 18 aa, Brucella spp.
RRGSREASTSKDLTEHPW

SEQ ID NO: 58 - protein, 8 aa, Brucella spp.
AGHTGHSE

SEQ ID NO: 59 - protein, 5 aa, Brucella spp.
RPFSN

SEQ ID NO: 60 - protein, 8 aa, Brucella spp.
SDNALRDT

SEQ ID NO: 61 - protein, 17 aa, Brucella spp.
NGNLSAAERRLRQAQEA

SEQ ID NO: 62 - protein, 11 aa, Brucella spp.
LQNGASQEEIE

SEQ ID NO: 63 - protein, 19 aa, Brucella spp.
QRQQQNPNARRQAPDPNAR

SEQ ID NO: 64 - protein, 11 aa, Brucella spp.
ARQGSRDQATQ

SEQ ID NO: 65 - protein, 18 aa, Brucella spp.
QAQQGQGNGQGQQGQMQE

SEQ ID NO: 66 - protein, 7 aa, Brucella spp.
QQETMNE

SEQ ID NO: 67 - protein, 13 aa, Brucella spp.
RQFGGSDGEGEFG

SEQ ID NO: 68 - protein, 24 aa, Brucella spp.
MPGDDGSADADSCQNSQGDVPPDM

SEQ ID NO: 69 - protein, 11 aa, Brucella spp.
QQKQKDLQSDL

SEQ ID NO: 70 - protein, 39 aa, Brucella spp.
MGIEPGKDFSEAEKSMGNATDALGRNEGSEANDQQGNAL

SEQ ID NO: 71 - protein, 33 aa, Brucella spp.
AMGQEGQSQGMKGGKGRDPLGRQSGTDGTGFGN

SEQ ID NO: 72 - protein, 6 aa, Brucella spp.
ALTPQM

SEQ ID NO: 73 - protein, 8 aa, Brucella spp.
QNAKSGNR

SEQ ID NO: 74 - protein, 7 aa, Brucella spp.
PSGNVVD

SEQ ID NO: 75 - protein, 12 aa, Brucella spp.
NLAAESDAASAQ

SEQ ID NO: 76 - protein, 8 aa, Brucella spp.
DAAATGGV

SEQ ID NO: 77 - protein, 5 aa, Brucella spp.
AEKPI

SEQ ID NO: 78 - protein, 14 aa, Brucella spp.
TGPDGKKMTLGDYK

SEQ ID NO: 79 - protein, 10 aa, Brucella spp.
LQGEKGGNDF

SEQ ID NO: 80 - protein, 11 aa, Brucella spp.
DTGSDDKPKGF

SEQ ID NO: 81 - protein, 9 aa, Brucella spp.
GPAPWDSPD

SEQ ID NO: 82 - protein, 7 aa, Brucella spp.
GGDGNFS

SEQ ID NO: 83 - protein, 5 aa, Brucella spp.
SDKLG

SEQ ID NO: 84 - protein, 4 aa, Brucella spp.
GPAY

SEQ ID NO: 85 - protein, 8 aa, Brucella spp.
WAPRSERG

SEQ ID NO: 86 - protein, 12 aa, Brucella spp.
NRPEDHPKVSEE

SEQ ID NO: 87 - protein, 12 aa, Brucella spp.
GEVQSSSAKSHG

SEQ ID NO: 88 - protein, 4 aa, Brucella spp.
NSLP

SEQ ID NO: 89 - protein, 10 aa, Brucella spp.
SSPTDKMGTY

SEQ ID NO: 90 - protein, 14 aa, Brucella spp.
HNEYTPGRFTKAGR

SEQ ID NO: 91 - protein, 6 aa, Brucella spp.
QASKMA

SEQ ID NO: 92 - protein, 6 aa, Brucella spp.
RTMTGS

SEQ ID NO: 93 - protein, 4 aa, Brucella spp.
SAMA

SEQ ID NO: 94 - protein, 10 aa, Brucella spp.
EKSETERREV

SEQ ID NO: 95 - protein, 28 aa, Brucella spp.
WNAGPRDESLKPSGRLAGRAERASANFR

SEQ ID NO: 96 - protein, 6 aa, Brucella spp.
GDPSGW

SEQ ID NO: 97 - protein, 5 aa, Brucella spp.
TSEEC

SEQ ID NO: 98 - protein, 7 aa, Brucella spp.
MEKHTAS

SEQ ID NO: 99 - protein, 11 aa, Brucella spp.
RGLGSAKEGTS

SEQ ID NO: 100 - protein, 5 aa, Brucella spp.
ASYAE

SEQ ID NO: 101 - protein, 15 aa, Brucella spp.
MAQDTAPAPTLDTGD

SEQ ID NO: 102 - protein, 5 aa, Brucella spp.
TDGGS

SEQ ID NO: 103 - protein, 7 aa, Brucella spp.
RDGYGHT

SEQ ID NO: 104 - protein, 10 aa, Brucella spp.
AGSAAGANAL

SEQ ID NO: 105 - protein, 4 aa, Brucella spp.
ATAG

SEQ ID NO: 106 - protein, 4 aa, Brucella spp.
GKPS

SEQ ID NO: 107 - protein, 10 aa, Brucella spp.
INPASEGATI

SEQ ID NO: 108 - protein, 9 aa, Brucella spp.
RPGKQAEIE

SEQ ID NO: 109 - protein, 4 aa, Brucella spp.
QGLT

SEQ ID NO: 110 - protein, 7 aa, Brucella spp.
ATPEEGQ

SEQ ID NO: 111 - protein, 8 aa, Brucella spp.
ADKTGARK

SEQ ID NO: 112 - protein, 7 aa, Brucella spp.
SPETGRT

SEQ ID NO: 113 - protein, 10 aa, Brucella spp.
QLGEGARITG

SEQ ID NO: 114 - protein, 9 aa, Brucella spp.
DAAKGEPLR

SEQ ID NO: 115 - protein, 7 aa, Brucella spp.
PVQASSR

SEQ ID NO: 116 - protein, 8 aa, Brucella spp.
IKPEESGR

SEQ ID NO: 117 - protein, 6 aa, Brucella spp.
ISGSAA

SEQ ID NO: 118 - protein, 9 aa, Brucella spp.
EVDERSAPE

SEQ ID NO: 119 - protein, 6 aa, Brucella spp.
ANAGLP

SEQ ID NO: 120 - protein, 20 aa, Brucella spp.
QPNAFATGRNPENAAVAATT

SEQ ID NO: 121 - protein, 7 aa, Brucella spp.
NRENGNG

SEQ ID NO: 122 - protein, 14 aa, Brucella spp.
RTREYAADKRGAEI

SEQ ID NO: 123 - protein, 4 aa, Brucella spp.
KIAR

SEQ ID NO: 124 - protein, 11 aa, Brucella spp.
IPNEEAEHNPA

SEQ ID NO: 125 - protein, 6 aa, Brucella spp.
SGRGAD

SEQ ID NO: 126 - protein, 8 aa, Brucella spp.
THPDTDNR

SEQ ID NO: 127 - protein, 6 aa, Brucella spp.
AETGIR

SEQ ID NO: 128 - protein, 35 aa, Brucella spp.
ARAAAPSQNSGPWGQRSDNAGGNSNGGSRYRGPWS

SEQ ID NO: 129 - protein, 9 aa, Brucella spp.
NGRPEGYGS

SEQ ID NO: 130 - protein, 12 aa, Brucella spp.
DTGGRKGGPVGG

SEQ ID NO: 131 - protein, 4 aa, Brucella spp.
SPAG

SEQ ID NO: 132 - protein, 11 aa, Brucella spp.
LPAAQQSRARR

SEQ ID NO: 133 - protein, 13 aa, Brucella spp.
VDPDDSKGNIGGK

SEQ ID NO: 134 - protein, 8 aa, Brucella spp.
TASKRIGE

SEQ ID NO: 135 - protein, 9 aa, Brucella spp.
GANNKGAIN

SEQ ID NO: 136 - protein, 11 aa, Brucella spp.
RVEQPRSDRQS

SEQ ID NO: 137 - protein, 13 aa, Brucella spp.
LTAEEGRKRRSLK

SEQ ID NO: 138 - protein, 7 aa, Brucella spp.
RSQSGEI

SEQ ID NO: 139 - protein, 7 aa, Brucella spp.
SSDTTQI

SEQ ID NO: 140 - protein, 5 aa, Brucella spp.
RRSRM

SEQ ID NO: 141 - protein, 6 aa, Brucella spp.
AYASEQ

SEQ ID NO: 142 - protein, 10 aa, Brucella spp.
AYQAARSSIQ

SEQ ID NO: 143 - protein, 4 aa, Brucella spp.
SAGT

SEQ ID NO: 144 - protein, 13 aa, Brucella spp.
VGGELAQAAGATE

SEQ ID NO: 145 - protein, 8 aa, Brucella spp.
KPGITAPA

SEQ ID NO: 146 - protein, 7 aa, Brucella spp.
PKPPRGE

SEQ ID NO: 147 - protein, 10 aa, Brucella spp.
PTRPDAPSLN

SEQ ID NO: 148 - protein, 6 aa, Brucella spp.
VKPGET

SEQ ID NO: 149 - protein, 9 aa, Brucella spp.
GPSGAGKST

SEQ ID NO: 150 - protein, 5 aa, Brucella spp.
DPQSG

SEQ ID NO: 151 - protein, 8 aa, Brucella spp.
PNADPHDV

SEQ ID NO: 152 - protein, 9 aa, Brucella spp.
GKPGASDAE

SEQ ID NO: 153 - protein, 10 aa, Brucella spp.
GYDTEVGERG

SEQ ID NO: 154 - protein, 4 aa, Brucella spp.
SGGQ

SEQ ID NO: 155 - protein, 7 aa, Brucella spp.
TSALDAE

SEQ ID NO: 156 - protein, 7 aa, Brucella spp.
EEGTHES

SEQ ID NO: 157 - protein, 12 aa, Brucella spp.
LDEGRDYDPYRL

SEQ ID NO: 158 - protein, 12 aa, Brucella spp.
RDGDREGTARPP

SEQ ID NO: 159 - protein, 8 aa, Brucella spp.
RLDESRDI

SEQ ID NO: 160 - protein, 11 aa, Brucella spp.
LDPNSGSTGDV

SEQ ID NO: 161 - protein, 8 aa, Brucella spp.
LQAPLSGM

SEQ ID NO: 162 - protein, 6 aa, Brucella spp.
AGRAQN

SEQ ID NO: 163 - protein, 16 aa, Brucella spp.
DLGSDLSGDHHGSTDE

SEQ ID NO: 164 - protein, 11 aa, Brucella spp.
GDDASTQRTTA

SEQ ID NO: 165 - protein, 4 aa, Brucella spp.
RNEQ

SEQ ID NO: 166 - protein, 9 aa, Brucella spp.
KQADGQKAI

SEQ ID NO: 167 - protein, 16 aa, Brucella spp.
AMGERQHRPERTDKPE

SEQ ID NO: 168 - protein, 5 aa, Brucella spp.
GRDTR

SEQ ID NO: 169 - protein, 4 aa, Brucella spp.
FSDS

SEQ ID NO: 170 - protein, 7 aa, Brucella spp.
GGGQLPK

SEQ ID NO: 171 - protein, 6 aa, Brucella spp.
RTAPEH

SEQ ID NO: 172 - protein, 5 aa, Brucella spp.
PGGLP

SEQ ID NO: 173 - protein, 13 aa, Brucella spp.
KGAVQAKPAPAAE

SEQ ID NO: 174 - protein, 11 aa, Brucella spp.
SPGQRTNSREI

SEQ ID NO: 175 - protein, 5 aa, Brucella spp.
SNGRV

SEQ ID NO: 176 - protein, 4 aa, Brucella spp.
GQRI

SEQ ID NO: 177 - protein, 21 aa, Brucella spp.
SGTLADNGSTFQTYSPGDTGL

SEQ ID NO: 178 - protein, 11 aa, Brucella spp.
TARPESDGSSS

SEQ ID NO: 179 - protein, 8 aa, Brucella spp.
QGGPRGAM

SEQ ID NO: 180 - protein, 8 aa, Brucella spp.
VDEAKQDL

SEQ ID NO: 181 - protein, 4 aa, Brucella spp.
GKIP

SEQ ID NO: 182 - protein, 8 aa, Brucella spp.
GPPGTGKT

SEQ ID NO: 183 - protein, 5 aa, Brucella spp.
VAGEA

SEQ ID NO: 184 - protein, 4 aa, Brucella spp.
AKKN

SEQ ID NO: 185 - protein, 18 aa, Brucella spp.
GRHRGAGLGGGNDEREQT

SEQ ID NO: 186 - protein, 5 aa, Brucella spp.
NRPDV

SEQ ID NO: 187 - protein, 9 aa, Brucella spp.
RGTPGFSGA

SEQ ID NO: 188 - protein, 5 aa, Brucella spp.
FEDSK

SEQ ID NO: 189 - protein, 15 aa, Brucella spp.
RSAMTPEEKTNTAYH

SEQ ID NO: 190 - protein, 6 aa, Brucella spp.
KADPVH

SEQ ID NO: 191 - protein, 7 aa, Brucella spp.
EGDRYSA

SEQ ID NO: 192 - protein, 16 aa, Brucella spp.
KENITSGASSDIQQAT

SEQ ID NO: 193 - protein, 7 aa, Brucella spp.
AYGDNQE

SEQ ID NO: 194 - protein, 11 aa, Brucella spp.
SRTQNISEETA

SEQ ID NO: 195 - protein, 4 aa, Brucella spp.
TGDE

SEQ ID NO: 196 - protein, 46 aa, Brucella spp.
GNKPSRDQGNDTPSRGSGVPKAGSSRKRKGSEPGGEPGMEPKPQPQ

SEQ ID NO: 197 - protein, 12 aa, Brucella spp.
DGIRGQANSFPM

SEQ ID NO: 198 - protein, 7 aa, Brucella spp.
KGQASRA

SEQ ID NO: 199 - protein, 8 aa, Brucella spp.
GKDTRRSG

SEQ ID NO: 200 - protein, 4 aa, Brucella spp.
NPFY

SEQ ID NO: 201 - protein, 11 aa, Brucella spp.
GDVGRAKRVDG

SEQ ID NO: 202 - protein, 6 aa, Brucella spp.
NGAGYK

SEQ ID NO: 203 - protein, 8 aa, Brucella spp.
NNEPNGIN

SEQ ID NO: 204 - protein, 7 aa, Brucella spp.
DCGSTHP

SEQ ID NO: 205 - protein, 4 aa, Brucella spp.
DGDA

SEQ ID NO: 206 - protein, 5 aa, Brucella spp.
GTVID

SEQ ID NO: 207 - protein, 7 aa, Brucella spp.
SNRLEGG

SEQ ID NO: 208 - protein, 7 aa, Brucella spp.
VGGEQSG

SEQ ID NO: 209 - protein, 6 aa, Brucella spp.
ATTGDG

SEQ ID NO: 210 - protein, 8 aa, Brucella spp.
QEQNKPIS

SEQ ID NO: 211 - protein, 12 aa, Brucella spp.
RTTGGKPLENKR

SEQ ID NO: 212 - protein, 14 aa, Brucella spp.
KSAIDEAKERLGGQ

SEQ ID NO: 213 - protein, 6 aa, Brucella spp.
PSGTEP

SEQ ID NO: 214 - protein, 6 aa, Brucella spp.
GDDRGL

SEQ ID NO: 215 - protein, 6 aa, Brucella spp.
PRPLNR

SEQ ID NO: 216 - protein, 6 aa, Brucella spp.
IGGEVP

SEQ ID NO: 217 - protein, 6 aa, Brucella spp.
DQVEGE

SEQ ID NO: 218 - protein, 8 aa, Brucella spp.
EAASEMEE

SEQ ID NO: 219 - protein, 10 aa, Brucella spp.
KRVSDADTRK

SEQ ID NO: 220 - protein, 15 aa, Brucella spp.
AQQEKQHEAKAESLE

SEQ ID NO: 221 - protein, 15 aa, Brucella spp.
LTPDNVQDEERAAER

SEQ ID NO: 222 - protein, 4 aa, Brucella spp.
TQDT

SEQ ID NO: 223 - protein, 4 aa, Brucella spp.
SVGA

SEQ ID NO: 224 - protein, 13 aa, Brucella spp.
DDGKLSGRGSPIK

SEQ ID NO: 225 - protein, 13 aa, Brucella spp.
QQPASARKRAKGK

SEQ ID NO: 226 - protein, 10 aa, Brucella spp.
KADGEKSSYL

SEQ ID NO: 227 - protein, 6 aa, Brucella spp.
VTRGDI

SEQ ID NO: 228 - protein, 7 aa, Brucella spp.
AQVSGQL

SEQ ID NO: 229 - protein, 6 aa, Brucella spp.
DPSPFE

SEQ ID NO: 230 - protein, 4 aa, Brucella spp.
DAQL

SEQ ID NO: 231 - protein, 6 aa, Brucella spp.
NAARQK

SEQ ID NO: 232 - protein, 14 aa, Brucella spp.
ATRGVSQATVDQAN

SEQ ID NO: 233 - protein, 11 aa, Brucella spp.
IRQQEAQLASD

SEQ ID NO: 234 - protein, 10 aa, Brucella spp.
EAAKEGETLN

SEQ ID NO: 235 - protein, 5 aa, Brucella spp.
QSAPT

SEQ ID NO: 236 - protein, 6 aa, Brucella spp.
VSEADI

SEQ ID NO: 237 - protein, 4 aa, Brucella spp.
LKPG

SEQ ID NO: 238 - protein, 7 aa, Brucella spp.
PDKRFTG

SEQ ID NO: 239 - protein, 8 aa, Brucella spp.
KPTPATDN

SEQ ID NO: 240 - protein, 5 aa, Brucella spp.
PNPTG

SEQ ID NO: 241 - protein, 13 aa, Brucella spp.
LTDKQKGGKPQVT

SEQ ID NO: 242 - protein, 7 aa, Brucella spp.
ADESGTL

SEQ ID NO: 243 - protein, 7 aa, Brucella spp.
SGLEEGD

SEQ ID NO: 244 - protein, 21 aa, Brucella spp.
AATGNGAAGGERGRRPSMRFF

SEQ ID NO: 245 - protein, 18 aa, Brucella spp.
TAMAGNDDPLPVKPRTLK

SEQ ID NO: 246 - protein, 5 aa, Brucella spp.
GRAKR

SEQ ID NO: 247 - protein, 5 aa, Brucella spp.
NYGGP

SEQ ID NO: 248 - protein, 17 aa, Brucella spp.
GAAEEKKRKQKIEADKS

SEQ ID NO: 249 - protein, 22 aa, Brucella spp.
HQDSGYQDYQQGYYPDEQPEPV

SEQ ID NO: 250 - protein, 30 aa, Brucella spp.
RKPEPAIAEEARSDIPGQIAAPAKPEPPKL

SEQ ID NO: 251 - protein, 7 aa, Brucella spp.
SLSGDQL

SEQ ID NO: 252 - protein, 5 aa, Brucella spp.
PDGGT

SEQ ID NO: 253 - protein, 10 aa, Brucella spp.
THPPACDSAP

SEQ ID NO: 254 - protein, 7 aa, Brucella spp.
RGTTSAD

SEQ ID NO: 255 - protein, 5 aa, Brucella spp.
APATI

SEQ ID NO: 256 - protein, 5 aa, Brucella spp.
GAPPV

SEQ ID NO: 257 - protein, 8 aa, Brucella spp.
TSGPGATT

SEQ ID NO: 258 - protein, 17 aa, Brucella spp.
RREVQRRRDEQAAFRMG

SEQ ID NO: 259 - protein, 5 aa, Brucella spp.
SNATG

SEQ ID NO: 260 - protein, 10 aa, Brucella spp.
PLPEPEPRKS

SEQ ID NO: 261 - protein, 6 aa, Brucella spp.
EASSTP

SEQ ID NO: 262 - protein, 7 aa, Brucella spp.
ERFGPEK

SEQ ID NO: 263 - protein, 5 aa, Brucella spp.
YDSYT

SEQ ID NO: 264 - protein, 7 aa, Brucella spp.
ADDNHPF

SEQ ID NO: 265 - protein, 10 aa, Brucella spp.
FRSPALEADG

SEQ ID NO: 266 - protein, 4 aa, Brucella spp.
PTEE

SEQ ID NO: 267 - protein, 7 aa, Brucella spp.
ANAGGAI

SEQ ID NO: 268 - protein, 5 aa, Brucella spp.
AQIGN

SEQ ID NO: 269 - protein, 17 aa, Brucella spp.
PEDEAKLPPGTSSVPFA

SEQ ID NO: 270 - protein, 5 aa, Brucella spp.
EREPL

SEQ ID NO: 271 - protein, 7 aa, Brucella spp.
RSQSQQL

SEQ ID NO: 272 - protein, 14 aa, Brucella spp.
AEAGQPGENEDGYA

SEQ ID NO: 273 - protein, 5 aa, Brucella spp.
PPSRV

SEQ ID NO: 274 - protein, 10 aa, Brucella spp.
DVPANKSALG

SEQ ID NO: 275 - protein, 6 aa, Brucella spp.
GRPDEF

SEQ ID NO: 276 - protein, 9 aa, Brucella spp.
APRYGISGK

SEQ ID NO: 277 - protein, 10 aa, Brucella spp.
GKNLGNPAPV

SEQ ID NO: 278 - protein, 13 aa, Brucella spp.
VSEEEAQVGRETP

SEQ ID NO: 279 - protein, 15 aa, Brucella spp.
PALPGEVTDTNNRAV

SEQ ID NO: 280 - protein, 9 aa, Brucella spp.
GEPHNGERT

SEQ ID NO: 281 - protein, 11 aa, Brucella spp.
PPEKQDGTPIN

SEQ ID NO: 282 - protein, 13 aa, Brucella spp.
GPEYAGETSIART

SEQ ID NO: 283 - protein, 8 aa, Brucella spp.
ALPTGTVT

SEQ ID NO: 284 - protein, 17 aa, Brucella spp.
RHPVTRGLNGSDQEPPH

SEQ ID NO: 285 - protein, 15 aa, Brucella spp.
DAPQGETVMSGADNK

SEQ ID NO: 286 - protein, 7 aa, Brucella spp.
EGGGPYA

SEQ ID NO: 287 - protein, 4 aa, Brucella spp.
LEEE

SEQ ID NO: 288 - protein, 11 aa, Brucella spp.
ALTATGNGRTL

SEQ ID NO: 289 - protein, 10 aa, Brucella spp.
QTMGDNPGMA

SEQ ID NO: 290 - protein, 11 aa, Brucella spp.
DITTPSGKTLR

SEQ ID NO: 291 - protein, 8 aa, Brucella spp.
LARSKPGL

SEQ ID NO: 292 - protein, 6 aa, Brucella spp.
DAPEFA

SEQ ID NO: 293 - protein, 7 aa, Brucella spp.
AAATGGA

SEQ ID NO: 294 - protein, 5 aa, Brucella spp.
AQSSV

SEQ ID NO: 295 - protein, 9 aa, Brucella spp.
GNRAANGND

SEQ ID NO: 296 - protein, 7 aa, Brucella spp.
TADTQLK

SEQ ID NO: 297 - protein, 8 aa, Brucella spp.
AVSRPRSA

SEQ ID NO: 298 - protein, 9 aa, Brucella spp.
PTDQGKINQ

SEQ ID NO: 299 - protein, 25 aa, Brucella spp.
SAPAESSQASIRRGSTGAGITIEPG

SEQ ID NO: 300 - protein, 9 aa, Brucella spp.
PPRPQEETF

SEQ ID NO: 301 - protein, 7 aa, Brucella spp.
EEVPSKS

SEQ ID NO: 302 - protein, 5 aa, Brucella spp.
LPGNE

SEQ ID NO: 303 - protein, 6 aa, Brucella spp.
ASAEDW

SEQ ID NO: 304 - protein, 8 aa, Brucella spp.
SDAQGANA

SEQ ID NO: 305 - protein, 19 aa, Brucella spp.
AEPANAEIGPYDGRRATER

SEQ ID NO: 306 - protein, 6 aa, Brucella spp.
PRPIPV

SEQ ID NO: 307 - protein, 10 aa, Brucella spp.
LASPADDKTF

SEQ ID NO: 308 - protein, 22 aa, Brucella spp.
DNKADSLEATAVRPDGITTPRQ

SEQ ID NO: 309 - protein, 13 aa, Brucella spp.
AAAYDDKGRRIAE

SEQ ID NO: 310 - protein, 6 aa, Brucella spp.
SAKGTA

SEQ ID NO: 311 - protein, 6 aa, Brucella spp.
EQAGAT

SEQ ID NO: 312 - protein, 7 aa, Brucella spp.
AGSQRRT

SEQ ID NO: 313 - protein, 8 aa, Brucella spp.
SGDGDLAQ

SEQ ID NO: 314 - protein, 4 aa, Brucella spp.
EPRS

SEQ ID NO: 315 - protein, 11 aa, Brucella spp.
RLAGASDNDPL

SEQ ID NO: 316 - protein, 8 aa, Brucella spp.
KGERALGG

SEQ ID NO: 317 - protein, 4 aa, Brucella spp.
WSEP

SEQ ID NO: 318 - protein, 9 aa, Brucella spp.
AFPDKSPFA

SEQ ID NO: 319 - protein, 12 aa, Brucella spp.
TPLVTGERRGHG

SEQ ID NO: 320 - protein, 13 aa, Brucella spp.
QRTGAQDNQASLS

SEQ ID NO: 321 - protein, 11 aa, Brucella spp.
GALTPPTPEAK

SEQ ID NO: 322 - protein, 20 aa, Brucella spp.
NKQPSVGINTPPGFYGNEDG

SEQ ID NO: 323 - protein, 5 aa, Brucella spp.
PISRP

SEQ ID NO: 324 - protein, 10 aa, Brucella spp.
VSYTSDRSVS

SEQ ID NO: 325 - protein, 21 aa, Brucella spp.
HRAEAQEPQQVHDDSKPGDGA

SEQ ID NO: 326 - protein, 13 aa, Brucella spp.
KADTDNISKAGLK

SEQ ID NO: 327 - protein, 16 aa, Brucella spp.
ALEPGDPIGVDPAKDE

SEQ ID NO: 328 - protein, 9 aa, Brucella spp.
DASMPSPEA

SEQ ID NO: 329 - protein, 18 aa, Brucella spp.
QLQAGASLDPAASPANQR

SEQ ID NO: 330 - protein, 5 aa, Brucella spp.
PLEPV

SEQ ID NO: 331 - protein, 5 aa, Brucella spp.
GRYEG

SEQ ID NO: 332 - protein, 18 aa, Brucella spp.
TTPNASPQDRPVRTGDGV

SEQ ID NO: 333 - protein, 7 aa, Brucella spp.
DDQGNPL

SEQ ID NO: 334 - protein, 4 aa, Brucella spp.
PNDP

SEQ ID NO: 335 - protein, 5 aa, Brucella spp.
YKSDQ

SEQ ID NO: 336 - protein, 19 aa, Brucella spp.
KALHVIAVISWMAGMLYLP

SEQ ID NO: 337 - protein, 18 aa, Brucella spp.
VMEKRLLRFIINPAMVVT

SEQ ID NO: 338 - protein, 19 aa, Brucella spp.
LWMAWEIFGFQGGWLHAKL

SEQ ID NO: 339 - protein, 21 aa, Brucella spp.
CGTILFCVILSAFFSGSETAL

SEQ ID NO: 340 - protein, 20 aa, Brucella spp.
IATTMFLTFFGDAGVAYATL

SEQ ID NO: 341 - protein, 21 aa, Brucella spp.
FAEVLPKSWAISSPDRFSLNV

SEQ ID NO: 342 - protein, 17 aa, Brucella spp.
SPDRFSLNVARGVSLVV

SEQ ID NO: 343 - protein, 24 aa, Brucella spp.
SAAVNWIVRVILRLFGINLAVGRS

SEQ ID NO: 344 - protein, 20 aa, Brucella spp.
LPIRDINRALDWNLPDEEAT

SEQ ID NO: 345 - protein, 24 aa, Brucella spp.
QTIPEVKQAFTFHGKRFTVLKKEK

SEQ ID NO: 346 - protein, 18 aa, Brucella spp.
ILFFSIAFAASFSWIDGL

SEQ ID NO: 347 - protein, 19 aa, Brucella spp.
EPASFLGLGVPLWASLAFG

SEQ ID NO: 348 - protein, 18 aa, Brucella spp.
FFGTFWLVFGGCGSAILA

SEQ ID NO: 349 - protein, 18 aa, Brucella spp.
LGIGFLGVALAFGLTVLT

SEQ ID NO: 350 - protein, 21 aa, Brucella spp.
AKDLIPYWVAQVLGAIAAAAI

SEQ ID NO: 351 - protein, 24 aa, Brucella spp.
AGLLIEIILTAFFIIIILGSTSSL

SEQ ID NO: 352 - protein, 20 aa, Brucella spp.
AALSQLWLFWVAPLVGAVIG

SEQ ID NO: 353 - protein, 17 aa, Brucella spp.
QASEIARGFAGVKGTAI

SEQ ID NO: 354 - protein, 19 aa, Brucella spp.
ARLLEPWLGSGLNIDELPV

SEQ ID NO: 355 - protein, 22 aa, Brucella spp.
NIDELPVPRLVVVTIDENAPPD

SEQ ID NO: 356 - protein, 17 aa, Brucella spp.
REFEWHFFRTALKGALF

SEQ ID NO: 357 - protein, 26 aa, Brucella spp.
GAAAMLVFLVFSWWASYQIATPEGDQ

SEQ ID NO: 358 - protein, 20 aa, Brucella spp.
DISPIILLLIIFFIRQFMWT

SEQ ID NO: 359 - protein, 19 aa, Brucella spp.
RTITLVIAVPVFIAAYTAG

SEQ ID NO: 360 - protein, 18 aa, Brucella spp.
AYTAGWFYIADRLEAKAR

SEQ ID NO: 361 - protein, 17 aa, Brucella spp.
RINVVCDSISWQRPSEG

SEQ ID NO: 362 - protein, 18 aa, Brucella spp.
PSEGMAFRAGKFSSGSPL

SEQ ID NO: 363 - protein, 25 aa, Brucella spp.
GPAFIEFPGISPLEVNWSKFTSNTR

SEQ ID NO: 364 - protein, 18 aa, Brucella spp.
LARPFPTEIEIAARDVAV

SEQ ID NO: 365 - protein, 22 aa, Brucella spp.
GMLKLMGRFAGLKFAPSVIGNA

SEQ ID NO: 366 - protein, 20 aa, Brucella spp.
PRAARGAFLRLFSGEGAALR

SEQ ID NO: 367 - protein, 25 aa, Brucella spp.
LFSGEGAALRRLHLRTFLSIAIERL

SEQ ID NO: 368 - protein, 63 aa, Brucella spp.
LRTFLSIAIERLWPLVLPLILLLALFASLGWLGLFALMPRWLHMGVLAVFSLAGLVALYLPFR

SEQ ID NO: 369 - protein, 26 aa, Brucella spp.
FSLAGLVALYLPFRFRPPREEEIVAR

SEQ ID NO: 370 - protein, 23 aa, Brucella spp.
TGTHDPFAIALWREHQKRMAERL

SEQ ID NO: 371 - protein, 28 aa, Brucella spp.
PERDPFGLRAGVALLFVTAFAYSLGSTS

SEQ ID NO: 372 - protein, 25 aa, Brucella spp.
TLALSGIDARWKFVVTPDNPPTIRF

SEQ ID NO: 373 - protein, 17 aa, Brucella spp.
RALNGTLQLSYEIDDDY

SEQ ID NO: 374 - protein, 20 aa, Brucella spp.
DAPRLPLALPRRGSREASTS

SEQ ID NO: 375 - protein, 21 aa, Brucella spp.
LPERPFSNPLARAVAEQRRIL

SEQ ID NO: 376 - protein, 23 aa, Brucella spp.
RDHVLDMLSAIMLRPEETIRNAA

SEQ ID NO: 377 - protein, 20 aa, Brucella spp.
SGNRKIVLLAALAGVIAGIG

SEQ ID NO: 378 - protein, 18 aa, Brucella spp.
QCALKADALKALDAAATG

SEQ ID NO: 379 - protein, 17 aa, Brucella spp.
LKADALKALDAAATGGV

SEQ ID NO: 380 - protein, 25 aa, Brucella spp.
YKGKTLLVNLWATWCAPCREEMPAL

SEQ ID NO: 381 - protein, 27 aa, Brucella spp.
FNELKRKNLAFGLPVTLLVDKDGCQIA

SEQ ID NO: 382 - protein, 21 aa, Brucella spp.
MMQLRVFLQFIAVLLIVGAIY

SEQ ID NO: 383 - protein, 18 aa, Brucella spp.
GPTSYRYVIFAIVTILAL

SEQ ID NO: 384 - protein, 22 aa, Brucella spp.
ADWGSMLGYFGYGYMFGAILGG

SEQ ID NO: 385 - protein, 19 aa, Brucella spp.
KLGARKLWIIAGTAWSIVA

SEQ ID NO: 386 - protein, 25 aa, Brucella spp.
WAPRSERGFAVALGLLSTPLGAMLT

SEQ ID NO: 387 - protein, 17 aa, Brucella spp.
VGACVTILLGGKISDWL

SEQ ID NO: 388 - protein, 18 aa, Brucella spp.
AGSAWGVIGLMTLANACN

SEQ ID NO: 389 - protein, 21 aa, Brucella spp.
CNSLPNSVYWAVIIDSSPTDK

SEQ ID NO: 390 - protein, 21 aa, Brucella spp.
RREVPPLLKLALELGPLLVFF

SEQ ID NO: 391 - protein, 25 aa, Brucella spp.
LKLALELGPLLVFFFANARGEMLIE

SEQ ID NO: 392 - protein, 18 aa, Brucella spp.
FPILGSIGAPIFLATALF

SEQ ID NO: 393 - protein, 27 aa, Brucella spp.
EGWRKLTLRWGLFFIFLAIVNEIVWRN

SEQ ID NO: 394 - protein, 29 aa, Brucella spp.
DPSGWGILGAWLWFFSRIVYIPLYLAGIP

SEQ ID NO: 395 - protein, 18 aa, Brucella spp.
IPYLRSFVWLISLVGLGI

SEQ ID NO: 396 - protein, 18 aa, Brucella spp.
SWIGRLILFGYTWALLHH

SEQ ID NO: 397 - protein, 18 aa, Brucella spp.
GMKIVLVMLNTFFTVVVG

SEQ ID NO: 398 - protein, 17 aa, Brucella spp.
PGLALFYGGMVRKKNVL

SEQ ID NO: 399 - protein, 24 aa, Brucella spp.
FAITCLMSILWMIAGYSLAFTDGG

SEQ ID NO: 400 - protein, 17 aa, Brucella spp.
GTIPEYLFITFQMTFAI

SEQ ID NO: 401 - protein, 17 aa, Brucella spp.
EYLFITFQMTFAIITPA

SEQ ID NO: 402 - protein, 31 aa, Brucella spp.
FAERMKFSSMLVFLTLWLFIVYVPVAHWVWG

SEQ ID NO: 403 - protein, 18 aa, Brucella spp.
VPVAHWVWGGGFMASDGV

SEQ ID NO: 404 - protein, 22 aa, Brucella spp.
VIGAALLWVGWFGFNAGSAAGA

SEQ ID NO: 405 - protein, 18 aa, Brucella spp.
YVAAVKIKHVLGYDDSLD

SEQ ID NO: 406 - protein, 24 aa, Brucella spp.
RRGVWGWIFFDWAAQPFFTVVTTF

SEQ ID NO: 407 - protein, 17 aa, Brucella spp.
AAQPFFTVVTTFIFGPY

SEQ ID NO: 408 - protein, 22 aa, Brucella spp.
EEGQMAWGYGFAVAGLLIAILS

SEQ ID NO: 409 - protein, 18 aa, Brucella spp.
KPWIGFFAVLKIICLSLL

SEQ ID NO: 410 - protein, 26 aa, Brucella spp.
AVLKIICLSLLWFAVPGANLFWVLCA

SEQ ID NO: 411 - protein, 22 aa, Brucella spp.
WTITEIGLFGMILNVMAIISCL

SEQ ID NO: 412 - protein, 18 aa, Brucella spp.
ESGRYFGLYALAGRATSF

SEQ ID NO: 413 - protein, 20 aa, Brucella spp.
LGMSVLLLFFVAGFALTLIT

SEQ ID NO: 414 - protein, 19 aa, Brucella spp.
RSAPEYYRMVSGLAANAGL

SEQ ID NO: 415 - protein, 25 aa, Brucella spp.
AGAISMLGNFAFFLGGNRENGNGVM

SEQ ID NO: 416 - protein, 25 aa, Brucella spp.
RGAEICGNPLWLSSALGKIARGAKV

SEQ ID NO: 417 - protein, 28 aa, Brucella spp.
GLGCLIFAQPFLWVVLGSVWGFALFGRF

SEQ ID NO: 418 - protein, 17 aa, Brucella spp.
VLGSVWGFALFGRFISM

SEQ ID NO: 419 - protein, 32 aa, Brucella spp.
RARRIGIGAALVLRLALLFTISIIVQLTEPVF

SEQ ID NO: 420 - protein, 26 aa, Brucella spp.
GHGFSWRDIILVAGGLFLVWKATKEI

SEQ ID NO: 421 - protein, 20 aa, Brucella spp.
FGYHVPKGYIYAAMGFSALV

SEQ ID NO: 422 - protein, 34 aa, Brucella spp.
LKPLKRMMPFLAPYKVLVAGALFSLVLAAVTTLA

SEQ ID NO: 423 - protein, 25 aa, Brucella spp.
VNNYFGMLVLLAFALALASGLRYFF

SEQ ID NO: 424 - protein, 25 aa, Brucella spp.
ALASGLRYFFVISLGERVLADLRNA

SEQ ID NO: 425 - protein, 24 aa, Brucella spp.
AAIPIIVIPLIAFGRSVRRRSRMT

SEQ ID NO: 426 - protein, 20 aa, Brucella spp.
AILTAFAIFLVFSSIVAVLW

SEQ ID NO: 427 - protein, 27 aa, Brucella spp.
FAIFLVFSSIVAVLWFGSRDVLAGTMS

SEQ ID NO: 428 - protein, 17 aa, Brucella spp.
PDAPSLNGLGFTVKPGE

SEQ ID NO: 429 - protein, 17 aa, Brucella spp.
APSLNGLGFTVKPGETV

SEQ ID NO: 430 - protein, 24 aa, Brucella spp.
GQCQRIAIARALLRDAPILLLDEA

SEQ ID NO: 431 - protein, 29 aa, Brucella spp.
RLSSPRVVILSMLIFLIIVAFLAAILMRQ

SEQ ID NO: 432 - protein, 22 aa, Brucella spp.
LGVLLVGILLAFGQVLRLLPEI

SEQ ID NO: 433 - protein, 25 aa, Brucella spp.
VLRLLPEIRWVNSFRDGDREGTARP

SEQ ID NO: 434 - protein, 21 aa, Brucella spp.
EGTARPPVLLAPMRALIGRRQ

SEQ ID NO: 435 - protein, 27 aa, Brucella spp.
DISRYLIGLLVFLGLLGTFWGLLETVG

SEQ ID NO: 436 - protein, 24 aa, Brucella spp.
SLFGLSGSLILGFLDLQAGRAQNR

SEQ ID NO: 437 - protein, 17 aa, Brucella spp.
DVFRALALLTIFINHVP

SEQ ID NO: 438 - protein, 17 aa, Brucella spp.
LSLKMWRRASVLYITHI

SEQ ID NO: 439 - protein, 17 aa, Brucella spp.
FLARISLPLMLGVSGVV

SEQ ID NO: 440 - protein, 21 aa, Brucella spp.
ISLPLMLGVSGVVWFLSGLYH

SEQ ID NO: 441 - protein, 26 aa, Brucella spp.
FINPLSWQFLFAIGIAGVMHVRGGGQ

SEQ ID NO: 442 - protein, 17 aa, Brucella spp.
HPLLIGLAVGYLVLALA

SEQ ID NO: 443 - protein, 18 aa, Brucella spp.
IPLWSINISMGLPMVITG

SEQ ID NO: 444 - protein, 25 aa, Brucella spp.
ALAYYLEWLPTIGWGKKGAVQAKPA

SEQ ID NO: 445 - protein, 23 aa, Brucella spp.
ALWAIIALLLIALFNLFQSPGQR

SEQ ID NO: 446 - protein, 19 aa, Brucella spp.
DGSSSLIGILLSWLPMILI

SEQ ID NO: 447 - protein, 35 aa, Brucella spp.
SLIGILLSWLPMILILGVWIFFMRQMQGGPRGAMG

SEQ ID NO: 448 - protein, 19 aa, Brucella spp.
KNAPCIIFIDEIDAVGRHR

SEQ ID NO: 449 - protein, 26 aa, Brucella spp.
NRPDVLDPALLRPGRFDRQVVVPNPD

SEQ ID NO: 450 - protein, 23 aa, Brucella spp.
TIIPRGRALGMVMQLPEGDRYSA

SEQ ID NO: 451 - protein, 24 aa, Brucella spp.
PEGDRYSATYTWMVSRLAIMMGGR

SEQ ID NO: 452 - protein, 32 aa, Brucella spp.
NSFPMTPEIAMKVGMAVGYIFRRKGQASRAVI

SEQ ID NO: 453 - protein, 18 aa, Brucella spp.
GYMLENALVAGFTAAGMD

SEQ ID NO: 454 - protein, 18 aa, Brucella spp.
NALVAGFTAAGMDVFLLG

SEQ ID NO: 455 - protein, 18 aa, Brucella spp.
AAGMDVFLLGPIPTPAVA

SEQ ID NO: 456 - protein, 17 aa, Brucella spp.
FGPDGFKLSDQIELQIE

SEQ ID NO: 457 - protein, 17 aa, Brucella spp.
AGYKVAPAALWELGAEV

SEQ ID NO: 458 - protein, 21 aa, Brucella spp.
YKVAPAALWELGAEVITINNE

SEQ ID NO: 459 - protein, 19 aa, Brucella spp.
CGSTHPIGLMKKVHGVRAD

SEQ ID NO: 460 - protein, 17 aa, Brucella spp.
ERLGGQGRLVIRPSGTE

SEQ ID NO: 461 - protein, 25 aa, Brucella spp.
GALEFYDFIIFVFFASVIGHLFFPP

SEQ ID NO: 462 - protein, 18 aa, Brucella spp.
DMPDWLVLIQTFGIFAAG

SEQ ID NO: 463 - protein, 21 aa, Brucella spp.
KFGRKRVFAFSVFLMSISTLA

SEQ ID NO: 464 - protein, 23 aa, Brucella spp.
AIGGEVPGAWTFVAEHVPANRVG

SEQ ID NO: 465 - protein, 17 aa, Brucella spp.
FTPEELSAYAWRIPFFI

SEQ ID NO: 466 - protein, 30 aa, Brucella spp.
PEELSAYAWRIPFFIGGIFGLLAVYLRRWL

SEQ ID NO: 467 - protein, 17 aa, Brucella spp.
ISVLLTWILSAGIVVTT

SEQ ID NO: 468 - protein, 21 aa, Brucella spp.
PMAHAWYLVFIAVLTCGLGLY

SEQ ID NO: 469 - protein, 23 aa, Brucella spp.
HKARFGDRIPLIRREHVSGYYDR

SEQ ID NO: 470 - protein, 42 aa, Brucella spp.
GHSLPYLIKDFWSATSIAVILVFFELWAIAFIQNRYMETPFF

SEQ ID NO: 471 - protein, 19 aa, Brucella spp.
ETPFFRAALQVVFGGALVL

SEQ ID NO: 472 - protein, 38 aa, Brucella spp.
KRAKGKRRWWLWLSAAAIIIGAGWYFYGSYKADGEKSS

SEQ ID NO: 473 - protein, 28 aa, Brucella spp.
DISKLKPGMPVYFTLLGQPDKRFTGTLR

SEQ ID NO: 474 - protein, 23 aa, Brucella spp.
TDNNVVLYYALFDVPNPTGELMI

SEQ ID NO: 475 - protein, 24 aa, Brucella spp.
ELMIDMSAQVYFVLGEAKDVLVVP

SEQ ID NO: 476 - protein, 24 aa, Brucella spp.
ALAFFCIAAFLALAENYGGPIAAL

SEQ ID NO: 477 - protein, 19 aa, Brucella spp.
PAILKRPILAVALPLAGIA

SEQ ID NO: 478 - protein, 22 aa, Brucella spp.
MIRLLAVSIGVMLIGLMAVLIA

SEQ ID NO: 479 - protein, 17 aa, Brucella spp.
ESQIELAPGTRLLSQSL

SEQ ID NO: 480 - protein, 17 aa, Brucella spp.
LPDGGTEIIVYDYRQSR

SEQ ID NO: 481 - protein, 24 aa, Brucella spp.
LCLEERIPYYIGIPVLAVAWIACM

SEQ ID NO: 482 - protein, 18 aa, Brucella spp.
MAKWPPVLTRGLILVGAL

SEQ ID NO: 483 - protein, 18 aa, Brucella spp.
KAAEWWLAIIAFVESSVF

SEQ ID NO: 484 - protein, 17 aa, Brucella spp.
WWLAIIAFVESSVFLVP

SEQ ID NO: 485 - protein, 21 aa, Brucella spp.
LARPERAWRYALIATVASVLG

SEQ ID NO: 486 - protein, 22 aa, Brucella spp.
ARGARFFLLAWLLRRYGESIRH

SEQ ID NO: 487 - protein, 22 aa, Brucella spp.
LVIAVPYLWLLVFFLVPFFIVF

SEQ ID NO: 488 - protein, 19 aa, Brucella spp.
MVILPFWTSFLIRVYAWIG

SEQ ID NO: 489 - protein, 24 aa, Brucella spp.
PFAAFWKITFPLSLAGVLAGCFLV

SEQ ID NO: 490 - protein, 17 aa, Brucella spp.
AVGEFVIPDLLGGSQTL

SEQ ID NO: 491 - protein, 18 aa, Brucella spp.
NIVSVALGFAFLYLPIVL

SEQ ID NO: 492 - protein, 19 aa, Brucella spp.
VALGFAFLYLPIVLLVIYS

SEQ ID NO: 493 - protein, 17 aa, Brucella spp.
LYLPIVLLVIYSFNESR

SEQ ID NO: 494 - protein, 17 aa, Brucella spp.
NESRLVTVWAGFSTKWY

SEQ ID NO: 495 - protein, 18 aa, Brucella spp.
SRLVTVWAGFSTKWYGEL

SEQ ID NO: 496 - protein, 24 aa, Brucella spp.
DVITGLSLLLLFVAMNFDRGFWTV

SEQ ID NO: 497 - protein, 23 aa, Brucella spp.
FMTEEWQMVALWGVVIGLGTGMT

SEQ ID NO: 498 - protein, 19 aa, Brucella spp.
SSTPTFWVLFLTFFVCGFS

SEQ ID NO: 499 - protein, 24 aa, Brucella spp.
FDNRWLLFWFYALRGLSLIYLTFT

SEQ ID NO: 500 - protein, 25 aa, Brucella spp.
DFSVYELALFAIFYGLDWVATVPPT

SEQ ID NO: 501 - protein, 22 aa, Brucella spp.
FGPEKAGLIFGWVFTGHQVGAA

SEQ ID NO: 502 - protein, 24 aa, Brucella spp.
RLAAWSIPVAFGVMGLKYVAYALT

SEQ ID NO: 503 - protein, 18 aa, Brucella spp.
AAIGAWWAIRVSYLPADD

SEQ ID NO: 504 - protein, 20 aa, Brucella spp.
GVLITVAALLIFREAWFALE

SEQ ID NO: 505 - protein, 18 aa, Brucella spp.
AALLIFREAWFALETPRM

SEQ ID NO: 506 - protein, 23 aa, Brucella spp.
PRMLDEPWLGLGINMAAAAINGL

SEQ ID NO: 507 - protein, 19 aa, Brucella spp.
PLLAILVAINILWQGWHVI

SEQ ID NO: 508 - protein, 18 aa, Brucella spp.
VAINILWQGWHVINSSVQ

SEQ ID NO: 509 - protein, 17 aa, Brucella spp.
RIAGRVTFIEFHLVVAA

SEQ ID NO: 510 - protein, 19 aa, Brucella spp.
RVTFIEFHLVVAADMSVGD

SEQ ID NO: 511 - protein, 25 aa, Brucella spp.
LSTPWLIAILVPLALLVLATVFLRM

SEQ ID NO: 512 - protein, 18 aa, Brucella spp.
LLAAAALALALFNPVIIN

SEQ ID NO: 513 - protein, 20 aa, Brucella spp.
RETPVTITLPRAGVNIVEIA

SEQ ID NO: 514 - protein, 18 aa, Brucella spp.
AVDLVHFTILRPPEKQDG

SEQ ID NO: 515 - protein, 23 aa, Brucella spp.
TPINELSLIAFPTRELFVDKVSQ

SEQ ID NO: 516 - protein, 20 aa, Brucella spp.
RDVLPLLYYDYIAQYVENGG

SEQ ID NO: 517 - protein, 18 aa, Brucella spp.
NGGALLIAAGPEYAGETS

SEQ ID NO: 518 - protein, 17 aa, Brucella spp.
GETSIARTPLYSALPAL

SEQ ID NO: 519 - protein, 20 aa, Brucella spp.
QEPPHWSRWFRTIDIDAPQG

SEQ ID NO: 520 - protein, 28 aa, Brucella spp.
RVGMFLSDQGWLWARGFEGGGPYASLYR

SEQ ID NO: 521 - protein, 17 aa, Brucella spp.
FEGGGPYASLYRRIAHW

SEQ ID NO: 522 - protein, 38 aa, Brucella spp.
QLKSVNRLPLFSGFLALGLLLFIFGSMWYREGAVSRPR

SEQ ID NO: 523 - protein, 20 aa, Brucella spp.
PRSALPHMFTLRLPTDQGKI

SEQ ID NO: 524 - protein, 25 aa, Brucella spp.
AGLIALPVIWWLLRMTPPRPQEETF

SEQ ID NO: 525 - protein, 22 aa, Brucella spp.
EETFPPLRILAQVFRREEVPSK

SEQ ID NO: 526 - protein, 27 aa, Brucella spp.
EEVPSKSPWWMTLLRLLIAGLVILALA

SEQ ID NO: 527 - protein, 25 aa, Brucella spp.
SALPQDMKIRLAFLSDGLASPADDK

SEQ ID NO: 528 - protein, 24 aa, Brucella spp.
GRRIAEAPLSFALGSAKGTAHFNL

SEQ ID NO: 529 - protein, 25 aa, Brucella spp.
HFNLPVELRNDFRLIRVDGMEQAGA

SEQ ID NO: 530 - protein, 23 aa, Brucella spp.
LRKGERALGGTLSWSEPQKLRAF

SEQ ID NO: 531 - protein, 25 aa, Brucella spp.
QKLRAFPDKSPFAGLAIPQDVNVNR

SEQ ID NO: 532 - protein, 18 aa, Brucella spp.
NIVLFHIAPDATWSSLPI

SEQ ID NO: 533 - protein, 17 aa, Brucella spp.
SDRSVSLTGPFFAAAAM

SEQ ID NO: 534 - protein, 18 aa, Brucella spp.
VSLTGPFFAAAAMLLALD

SEQ ID NO: 535 - protein, 25 aa, Brucella spp.
LLALDTFLMLWLRGAFRRRMKVHSR

SEQ ID NO: 536 - protein, 26 aa, Brucella spp.
PAKDELAFYPLIYWPIDPDASMPSPE

SEQ ID NO: 537 - protein, 17 aa, Brucella spp.
LTKAFFIMPDFPGRYEG

SEQ ID NO: 538 - protein, 26 aa, Brucella spp.
IAIERLWPLVLPLILLLALFASLGWL

SEQ ID NO: 539 - protein, 24 aa, Brucella spp.
LSWLPMILILGVWIFFMRQMQGGP

SEQ ID NO: 540 - protein, 24 aa, Brucella spp.
KLKPGMPVYFTLLGQPDKRFTGTL

SEQ ID NO: 541 - protein, 22 aa, Brucella spp.
LFASLGWLGLFALMPRWLHMGV

SEQ ID NO: 542 - protein, 22 aa, Brucella spp.
LKIICLSLLWFAVPGANLFWVL

SEQ ID NO: 543 - protein, 22 aa, Brucella spp.
RRIAEAPLSFALGSAKGTAHFN

SEQ ID NO: 544 - protein, 22 aa, Brucella spp.
KDELAFYPLIYWPIDPDASMPS

SEQ ID NO: 545 - protein, 21 aa, Brucella spp.
MKFSSMLVFLTLWLFIVYVPV

SEQ ID NO: 546 - protein, 20 aa, Brucella spp.
LRLLPEIRWVNSFRDGDREG

SEQ ID NO: 547 - protein, 20 aa, Brucella spp.
LAFFCIAAFLALAENYGGPI

SEQ ID NO: 548 - protein, 19 aa, Brucella spp.
RWLHMGVLAVFSLAGLVAL

SEQ ID NO: 549 - protein, 19 aa, Brucella spp.
SMLGNFAFFLGGNRENGNG

SEQ ID NO: 550 - protein, 19 aa, Brucella spp.
RVVILSMLIFLIIVAFLAA

SEQ ID NO: 551 - protein, 18 aa, Brucella spp.
VKQAFTFHGKRFTVLKKE

SEQ ID NO: 552 - protein, 18 aa, Brucella spp.
LILLLALFASLGWLGLFA

SEQ ID NO: 553 - protein, 18 aa, Brucella spp.
LGPLLVFFFANARGEMLI

SEQ ID NO: 554 - protein, 18 aa, Brucella spp.
KLTLRWGLFFIFLAIVNE

SEQ ID NO: 555 - protein, 18 aa, Brucella spp.
KRRWWLWLSAAAIIIGAG

SEQ ID NO: 556 - protein, 17 aa, Brucella spp.
AFIEFPGISPLEVNWSK

SEQ ID NO: 557 - protein, 17 aa, Brucella spp.
KNLAFGLPVTLLVDKDG

SEQ ID NO: 558 - protein, 17 aa, Brucella spp.
LALELGPLLVFFFANAR

SEQ ID NO: 559 - protein, 17 aa, Brucella spp.
MKVGMAVGYIFRRKGQA

SEQ ID NO: 560 - protein, 17 aa, Brucella spp.
SVYELALFAIFYGLDWV

SEQ ID NO: 561 - protein, 17 aa, Brucella spp.
YELALFAIFYGLDWVAT

SEQ ID NO: 562 - protein, 17 aa, Brucella spp.
LALFAIFYGLDWVATVP

SEQ ID NO: 563 - protein, 17 aa, Brucella spp.
QDMKIRLAFLSDGLASP

SEQ ID NO: 564 - protein, 22 aa, Brucella spp.
TGLWMAWEIFGFQGGWLHAKLL

SEQ ID NO: 565 - protein, 21 aa, Brucella spp.
CGTILFCVILSAFFSGSETAL

SEQ ID NO: 566 - protein, 23 aa, Brucella spp.
SIATTMFLTFFGDAGVAYATLAM

SEQ ID NO: 567 - protein, 25 aa, Brucella spp.
LAMTVILVIFAEVLPKSWAISSPDR

SEQ ID NO: 568 - protein, 30 aa, Brucella spp.
PLSAAVNWIVRVILRLFGINLAVGRSMLSP

SEQ ID NO: 569 - protein, 26 aa, Brucella spp.
GSVLDTILFFSIAFAASFSWIDGLTG

SEQ ID NO: 570 - protein, 26 aa, Brucella spp.
KVVMGTLMLIPYGAILAIFAPTLYAV

SEQ ID NO: 571 - protein, 33 aa, Brucella spp.
SMMAGLLIEIILTAFFIIIILGSTSSLAPAGFA

SEQ ID NO: 572 - protein, 26 aa, Brucella spp.
TAALSQLWLFWVAPLVGAVIGAIIWK

SEQ ID NO: 573 - protein, 24 aa, Brucella spp.
GNALVIVIAIMTFLACLTLGGVTL

SEQ ID NO: 574 - protein, 27 aa, Brucella spp.
FVAREFEWHFFRTALKGALFGGAAAML

SEQ ID NO: 575 - protein, 29 aa, Brucella spp.
FGGAAAMLVFLVFSWWASYQIATPEGDQA

SEQ ID NO: 576 - protein, 21 aa, Brucella spp.
AAGIIILVSILTMLTSRLTVI

SEQ ID NO: 577 - protein, 40 aa, Brucella spp.
KTFRKRTITLVIAVPVFIAAYTAGWFYIADRLEAKARADM

SEQ ID NO: 578 - protein, 23 aa, Brucella spp.
LTGPAFIEFPGISPLEVNWSKFT

SEQ ID NO: 579 - protein, 22 aa, Brucella spp.
STGMLKLMGRFAGLKFAPSVIG

SEQ ID NO: 580 - protein, 66 aa, Brucella spp.
GAALRRLHLRTFLSIAIERLWPLVLPLILLLALFASLGWLGLFALMPRWLHMGVLAVFSLAGLVAL

SEQ ID NO: 581 - protein, 26 aa, Brucella spp.
FSLAGLVALYLPFRFRPPREEEIVAR

SEQ ID NO: 582 - protein, 25 aa, Brucella spp.
KSGNRKIVLLAALAGVIAGIGAVYV

SEQ ID NO: 583 - protein, 27 aa, Brucella spp.
DYKGKTLLVNLWATWCAPCREEMPALD

SEQ ID NO: 584 - protein, 25 aa, Brucella spp.
ELKRKNLAFGLPVTLLVDKDGCQIA

SEQ ID NO: 585 - protein, 26 aa, Brucella spp.
NKMMQLRVFLQFIAVLLIVGAIYFAR

SEQ ID NO: 586 - protein, 25 aa, Brucella spp.
PTSYRYVIFAIVTILALVNYIDRGA

SEQ ID NO: 587 - protein, 32 aa, Brucella spp.
TGSWRSMYIVLGALGLILIVIFSRIYTNRPED

SEQ ID NO: 588 - protein, 34 aa, Brucella spp.
LVFNSIGYFAFQYVNFMILTWTPKYLSDEFGLTL

SEQ ID NO: 589 - protein, 22 aa, Brucella spp.
GKISDWLFLKTGKLRLARGGLA

SEQ ID NO: 590 - protein, 26 aa, Brucella spp.
AGRGIMRVVLLFGSAALALGLIIVPI

SEQ ID NO: 591 - protein, 28 aa, Brucella spp.
RKLTLRWGLFFIFLAIVNEIVWRNFSTD

SEQ ID NO: 592 - protein, 28 aa, Brucella spp.
WGILGAWLWFFSRIVYIPLYLAGIPYLR

SEQ ID NO: 593 - protein, 28 aa, Brucella spp.
LFSSWIGRLILFGYTWALLHHLAGGVRH

SEQ ID NO: 594 - protein, 24 aa, Brucella spp.
KEGTSHFWYQRLSAVALVPLVLFF

SEQ ID NO: 595 - protein, 25 aa, Brucella spp.
AVALVPLVLFFIGLVISLNGASYAE

SEQ ID NO: 596 - protein, 24 aa, Brucella spp.
TSTALVLMMTIPGLALFYGGMVRK

SEQ ID NO: 597 - protein, 20 aa, Brucella spp.
ITCLMSILWMIAGYSLAFTD

SEQ ID NO: 598 - protein, 26 aa, Brucella spp.
TGTIPEYLFITFQMTFAIITPALITG

SEQ ID NO: 599 - protein, 35 aa, Brucella spp.
ERMKFSSMLVFLTLWLFIVYVPVAHWVWGGGFMAS

SEQ ID NO: 600 - protein, 26 aa, Brucella spp.
RRGVWGWIFFDWAAQPFFTVVTTFIF

SEQ ID NO: 601 - protein, 20 aa, Brucella spp.
ICLSLLWFAVPGANLFWVLC

SEQ ID NO: 602 - protein, 31 aa, Brucella spp.
ITGPLAALWYFIFILPMFFFTPDAAKGEPLR

SEQ ID NO: 603 - protein, 24 aa, Brucella spp.
GMSVLLLFFVAGFALTLITPYPAD

SEQ ID NO: 604 - protein, 25 aa, Brucella spp.
LIALMTVMFMSIGYLLGGGGGMMIA

SEQ ID NO: 605 - protein, 23 aa, Brucella spp.
GGGMMIALVIAVAMNLFGYWNSD

SEQ ID NO: 606 - protein, 23 aa, Brucella spp.
VVGTLLAMIVAPFGAMIVQMAVS

SEQ ID NO: 607 - protein, 18 aa, Brucella spp.
NPATAHMFIINPLSGRGA

SEQ ID NO: 608 - protein, 17 aa, Brucella spp.
HMFIINPLSGRGADNLF

SEQ ID NO: 609 - protein, 24 aa, Brucella spp.
ALAGLVMLFVPGITMKLLRLQPIN

SEQ ID NO: 610 - protein, 26 aa, Brucella spp.
CLIFAQPFLWVVLGSVWGFALFGRFI

SEQ ID NO: 611 - protein, 23 aa, Brucella spp.
SLAALVEFLLAAGPLLYAFSFIS

SEQ ID NO: 612 - protein, 24 aa, Brucella spp.
LGIDNLIFISILTNKLPAAQQSRA

SEQ ID NO: 613 - protein, 25 aa, Brucella spp.
GAALVLRLALLFTISIIVQLTEPVF

SEQ ID NO: 614 - protein, 20 aa, Brucella spp.
GFSWRDIILVAGGLFLVWKA

SEQ ID NO: 615 - protein, 27 aa, Brucella spp.
IAANPTIVMLALGFLLMIGMTLIADGF

SEQ ID NO: 616 - protein, 17 aa, Brucella spp.
GFLLMIGMTLIADGFGY

SEQ ID NO: 617 - protein, 28 aa, Brucella spp.
RSLKPLKRMMPFLAPYKVLVAGALFSLV

SEQ ID NO: 618 - protein, 33 aa, Brucella spp.
GSNAVFVNNYFGMLVLLAFALALASGLRYFFVI

SEQ ID NO: 619 - protein, 26 aa, Brucella spp.
ALASGLRYFFVISLGERVLADLRNAV

SEQ ID NO: 620 - protein, 23 aa, Brucella spp.
SVALRNMILGIGALAMMVVTSPK

SEQ ID NO: 621 - protein, 28 aa, Brucella spp.
SALVIAAIPIIVIPLIAFGRSVRRRSRM

SEQ ID NO: 622 - protein, 28 aa, Brucella spp.
AILTAFAIFLVFSSIVAVLWFGSRDVLA

SEQ ID NO: 623 - protein, 35 aa, Brucella spp.
RLSSPRVVILSMLIFLIIVAFLAAILMRQIHTFFV

SEQ ID NO: 624 - protein, 27 aa, Brucella spp.
DISRYLIGLLVFLGLLGTFWGLLETVG

SEQ ID NO: 625 - protein, 35 aa, Brucella spp.
NILSMYAVMLILTPILLFLARISLPLMLGVSGVVW

SEQ ID NO: 626 - protein, 30 aa, Brucella spp.
NYPTEGVWFINPLSWQFLFAIGIAGVMHVR

SEQ ID NO: 627 - protein, 18 aa, Brucella spp.
QFLFAIGIAGVMHVRGGG

SEQ ID NO: 628 - protein, 26 aa, Brucella spp.
ALWAIIALLLIALFNLFQSPGQRTNS

SEQ ID NO: 629 - protein, 42 aa, Brucella spp.
DGSSSLIGILLSWLPMILILGVWIFFMRQMQGGPRGAMGFGK

SEQ ID NO: 630 - protein, 28 aa, Brucella spp.
FTAAGMDVFLLGPIPTPAVAMLCRSLRA

SEQ ID NO: 631 - protein, 27 aa, Brucella spp.
KRVDGDIYRYIEFAKRTLPRNISLNGL

SEQ ID NO: 632 - protein, 21 aa, Brucella spp.
NLGLERFLADRNLTLARTKVG

SEQ ID NO: 633 - protein, 18 aa, Brucella spp.
GQGRLVIRPSGTEPLIRV

SEQ ID NO: 634 - protein, 19 aa, Brucella spp.
RLVIRPSGTEPLIRVMAEG

SEQ ID NO: 635 - protein, 48 aa, Brucella spp.
LGGALEFYDFIIFVFFASVIGHLFFPPDMPDWLVLIQTFGIFAAGYLV

SEQ ID NO: 636 - protein, 29 aa, Brucella spp.
ELSAYAWRIPFFIGGIFGLLAVYLRRWLA

SEQ ID NO: 637 - protein, 17 aa, Brucella spp.
GVATFVFYTYAAVSLPV

SEQ ID NO: 638 - protein, 17 aa, Brucella spp.
VFYTYAAVSLPVLFALY

SEQ ID NO: 639 - protein, 23 aa, Brucella spp.
ERKQFILTYIQPGLAGLMDGSVS

SEQ ID NO: 640 - protein, 31 aa, Brucella spp.
WSATSIAVILVFFELWAIAFIQNRYMETPFF

SEQ ID NO: 641 - protein, 35 aa, Brucella spp.
KRAKGKRRWWLWLSAAAIIIGAGWYFYGSYKADGE

SEQ ID NO: 642 - protein, 23 aa, Brucella spp.
KLKPGMPVYFTLLGQPDKRFTGT

SEQ ID NO: 643 - protein, 17 aa, Brucella spp.
YFTLLGQPDKRFTGTLR

SEQ ID NO: 644 - protein, 25 aa, Brucella spp.
ATDNNVVLYYALFDVPNPTGELMID

SEQ ID NO: 645 - protein, 26 aa, Brucella spp.
PNPTGELMIDMSAQVYFVLGEAKDVL

SEQ ID NO: 646 - protein, 17 aa, Brucella spp.
YFVLGEAKDVLVVPTAA

SEQ ID NO: 647 - protein, 24 aa, Brucella spp.
FCAAMVVFGAIALAFFCIAAFLAL

SEQ ID NO: 648 - protein, 20 aa, Brucella spp.
IALAFFCIAAFLALAENYGG

SEQ ID NO: 649 - protein, 26 aa, Brucella spp.
ILAAISLLLALITLAILKIQGAAEEK

SEQ ID NO: 650 - protein, 26 aa, Brucella spp.
ERVRRKMIRLLAVSIGVMLIGLMAVL

SEQ ID NO: 651 - protein, 25 aa, Brucella spp.
SIGVMLIGLMAVLIAVVYKINRKPE

SEQ ID NO: 652 - protein, 27 aa, Brucella spp.
LCLEERIPYYIGIPVLAVAWIACMAKW

SEQ ID NO: 653 - protein, 23 aa, Brucella spp.
ILVGALLMTIGLALSIYHTGVEL

SEQ ID NO: 654 - protein, 18 aa, Brucella spp.
LVPADVLFLPMALARPER

SEQ ID NO: 655 - protein, 18 aa, Brucella spp.
SADAILLMLITSGLAHLP

SEQ ID NO: 656 - protein, 17 aa, Brucella spp.
AILLMLITSGLAHLPPI

SEQ ID NO: 657 - protein, 17 aa, Brucella spp.
LLMLITSGLAHLPPIKV

SEQ ID NO: 658 - protein, 26 aa, Brucella spp.
IVARGARFFLLAWLLRRYGESIRHFI

SEQ ID NO: 659 - protein, 30 aa, Brucella spp.
LVIAVPYLWLLVFFLVPFFIVFKISLSEVA

SEQ ID NO: 660 - protein, 25 aa, Brucella spp.
RPTLLMMVILPFWTSFLIRVYAWIG

SEQ ID NO: 661 - protein, 29 aa, Brucella spp.
VSVALGFAFLYLPIVLLVIYSFNESRLVT

SEQ ID NO: 662 - protein, 19 aa, Brucella spp.
TGLSLLLLFVAMNFDRGFW

SEQ ID NO: 663 - protein, 27 aa, Brucella spp.
RTSVAIVIVFLLTALMLVLILMRDHPA

SEQ ID NO: 664 - protein, 25 aa, Brucella spp.
ASSTPTFWVLFLTFFVCGFSTNGLI

SEQ ID NO: 665 - protein, 30 aa, Brucella spp.
SDRFDNRWLLFWFYALRGLSLIYLTFTDFS

SEQ ID NO: 666 - protein, 26 aa, Brucella spp.
LITVAALLIFREAWFALETPRMLDEP

SEQ ID NO: 667 - protein, 27 aa, Brucella spp.
GWSVLDPLLAILVAINILWQGWHVINS

SEQ ID NO: 668 - protein, 22 aa, Brucella spp.
GRVTFIEFHLVVAADMSVGDAH

SEQ ID NO: 669 - protein, 39 aa, Brucella spp.
LSTPWLIAILVPLALLVLATVFLRMRAGLIRLLAAAALA

SEQ ID NO: 670 - protein, 27 aa, Brucella spp.
YQHRDVLPLLYYDYIAQYVENGGALLI

SEQ ID NO: 671 - protein, 18 aa, Brucella spp.
PHWSRWFRTIDIDAPQGE

SEQ ID NO: 672 - protein, 37 aa, Brucella spp.
KSVNRLPLFSGFLALGLLLFIFGSMWYREGAVSRPRS

SEQ ID NO: 673 - protein, 34 aa, Brucella spp.
GSPLILAGLIALPVIWWLLRMTPPRPQEETFPPL

SEQ ID NO: 674 - protein, 33 aa, Brucella spp.
EEVPSKSPWWMTLLRLLIAGLVILALASPIWNP

SEQ ID NO: 675 - protein, 34 aa, Brucella spp.
FFAAAAMLLALDTFLMLWLRGAFRRRMKVHSRTA

SEQ ID NO: 676 - protein, 29 aa, Brucella spp.
PAKDELAFYPLIYWPIDPDASMPSPEAIA

SEQ ID NO: 677 - protein, 23 aa, Brucella spp.
VIAVPVFIAAYTAGWFYIADRLE

SEQ ID NO: 678 - protein, 25 aa, Brucella spp.
AIERLWPLVLPLILLLALFASLGWL

SEQ ID NO: 679 - protein, 18 aa, Brucella spp.
LGAWLWFFSRIVYIPLYL

SEQ ID NO: 680 - protein, 19 aa, Brucella spp.
VFLTLWLFIVYVPVAHWVW

SEQ ID NO: 681 - protein, 26 aa, Brucella spp.
GPLAALWYFIFILPMFFFTPDAAKGE

SEQ ID NO: 682 - protein, 25 aa, Brucella spp.
ILLSWLPMILILGVWIFFMRQMQGG

SEQ ID NO: 683 - protein, 23 aa, Brucella spp.
EFYDFIIFVFFASVIGHLFFPPD

SEQ ID NO: 684 - protein, 24 aa, Brucella spp.
SIAVILVFFELWAIAFIQNRYMET

SEQ ID NO: 685 - protein, 24 aa, Brucella spp.
AKGKRRWWLWLSAAAIIIGAGWYF

SEQ ID NO: 686 - protein, 24 aa, Brucella spp.
IAVPYLWLLVFFLVPFFIVFKISL

SEQ ID NO: 687 - protein, 17 aa, Brucella spp.
FLYLPIVLLVIYSFNES

SEQ ID NO: 688 - protein, 24 aa, Brucella spp.
DNRWLLFWFYALRGLSLIYLTFTD

SEQ ID NO: 689 - protein, 24 aa, Brucella spp.
LIALPVIWWLLRMTPPRPQEETFP

SEQ ID NO: 690 - protein, 21 aa, Brucella spp.
SKSPWWMTLLRLLIAGLVILA

SEQ ID NO: 691 - protein, 4 aa, Brucella spp.
KTPV

SEQ ID NO: 692 - protein, 6 aa, Brucella spp.
NASAMR

SEQ ID NO: 693 - protein, 8 aa, Brucella spp.
ANYLPGPD

SEQ ID NO: 694 - protein, 17 aa, Brucella spp.
TGDTVEGPIRGPKEGER

SEQ ID NO: 695 - protein, 4 aa, Brucella spp.
DPEK

SEQ ID NO: 696 - protein, 8 aa, Brucella spp.
PTSKDLSP

SEQ ID NO: 697 - protein, 6 aa, Brucella spp.
LGKGQR

SEQ ID NO: 698 - protein, 6 aa, Brucella spp.
PPRTGK

SEQ ID NO: 699 - protein, 7 aa, Brucella spp.
RPEEVTD

SEQ ID NO: 700 - protein, 7 aa, Brucella spp.
TFDEPAA

SEQ ID NO: 701 - protein, 13 aa, Brucella spp.
VVPSSGKVLTGGV

SEQ ID NO: 702 - protein, 5 aa, Brucella spp.
NALQR

SEQ ID NO: 703 - protein, 7 aa, Brucella spp.
NIEEGGS

SEQ ID NO: 704 - protein, 4 aa, Brucella spp.
TGSR

SEQ ID NO: 705 - protein, 7 aa, Brucella spp.
KGTGNSE

SEQ ID NO: 706 - protein, 6 aa, Brucella spp.
SGTRKE

SEQ ID NO: 707 - protein, 4 aa, Brucella spp.
MGTT

SEQ ID NO: 708 - protein, 15 aa, Brucella spp.
KQTKSNAEFFDSMNT

SEQ ID NO: 709 - protein, 6 aa, Brucella spp.
GRLPSG

SEQ ID NO: 710 - protein, 4 aa, Brucella spp.
GPKT

SEQ ID NO: 711 - protein, 4 aa, Brucella spp.
PEPR

SEQ ID NO: 712 - protein, 8 aa, Brucella spp.
SRNGDAID

SEQ ID NO: 713 - protein, 5 aa, Brucella spp.
SFTGE

SEQ ID NO: 714 - protein, 8 aa, Brucella spp.
AETEGQRR

SEQ ID NO: 715 - protein, 7 aa, Brucella spp.
ASGNQRK

SEQ ID NO: 716 - protein, 9 aa, Brucella spp.
DESDVPGSV

SEQ ID NO: 717 - protein, 4 aa, Brucella spp.
SGKR

SEQ ID NO: 718 - protein, 8 aa, Brucella spp.
APNAGKSS

SEQ ID NO: 719 - protein, 8 aa, Brucella spp.
EEAGTTRD

SEQ ID NO: 720 - protein, 8 aa, Brucella spp.
AGLRETDS

SEQ ID NO: 721 - protein, 4 aa, Brucella spp.
SGPV

SEQ ID NO: 722 - protein, 8 aa, Brucella spp.
ADLGGSAS

SEQ ID NO: 723 - protein, 4 aa, Brucella spp.
TGSG

SEQ ID NO: 724 - protein, 6 aa, Brucella spp.
AVPTRQ

SEQ ID NO: 725 - protein, 5 aa, Brucella spp.
IEGDD

SEQ ID NO: 726 - protein, 15 aa, Brucella spp.
AGCEAASAAARAGAR

SEQ ID NO: 727 - protein, 5 aa, Brucella spp.
AIGGL

SEQ ID NO: 728 - protein, 15 aa, Brucella spp.
RKGPAVRGPRTQADR

SEQ ID NO: 729 - protein, 13 aa, Brucella spp.
FPAGRMGEKPALG

SEQ ID NO: 730 - protein, 10 aa, Brucella spp.
KTGTPPRLDG

SEQ ID NO: 731 - protein, 8 aa, Brucella spp.
QSADEEPV

SEQ ID NO: 732 - protein, 7 aa, Brucella spp.
RTTPETH

SEQ ID NO: 733 - protein, 4 aa, Brucella spp.
GNRD

SEQ ID NO: 734 - protein, 12 aa, Brucella spp.
GLDDDTVYPNGI

SEQ ID NO: 735 - protein, 7 aa, Brucella spp.
STSLPED

SEQ ID NO: 736 - protein, 5 aa, Brucella spp.
RSLET

SEQ ID NO: 737 - protein, 13 aa, Brucella spp.
INGTTGYEEAGAQ

SEQ ID NO: 738 - protein, 9 aa, Brucella spp.
ARRAAGSEP

SEQ ID NO: 739 - protein, 7 aa, Brucella spp.
TSRGVSE

SEQ ID NO: 740 - protein, 10 aa, Brucella spp.
ADNADQRLTP

SEQ ID NO: 741 - protein, 6 aa, Brucella spp.
EERRKR

SEQ ID NO: 742 - protein, 7 aa, Brucella spp.
QDGVRRS

SEQ ID NO: 743 - protein, 4 aa, Brucella spp.
LSNE

SEQ ID NO: 744 - protein, 13 aa, Brucella spp.
KLKQRKPETIAEA

SEQ ID NO: 745 - protein, 5 aa, Brucella spp.
DGITP

SEQ ID NO: 746 - protein, 5 aa, Brucella spp.
GGRQK

SEQ ID NO: 747 - protein, 11 aa, Brucella spp.
QKGGVGKTTTA

SEQ ID NO: 748 - protein, 11 aa, Brucella spp.
DPQGNASTGLG

SEQ ID NO: 749 - protein, 5 aa, Brucella spp.
NRPLS

SEQ ID NO: 750 - protein, 8 aa, Brucella spp.
ASSVPEAA

SEQ ID NO: 751 - protein, 8 aa, Brucella spp.
QSADRTRR

SEQ ID NO: 752 - protein, 6 aa, Brucella spp.
STINPE

SEQ ID NO: 753 - protein, 4 aa, Brucella spp.
NNLA

SEQ ID NO: 754 - protein, 9 aa, Brucella spp.
SEAPSHGKP

SEQ ID NO: 755 - protein, 5 aa, Brucella spp.
RSTSS

SEQ ID NO: 756 - protein, 7 aa, Brucella spp.
DKGLVNE

SEQ ID NO: 757 - protein, 5 aa, Brucella spp.
RRYAA

SEQ ID NO: 758 - protein, 5 aa, Brucella spp.
KLPLD

SEQ ID NO: 759 - protein, 15 aa, Brucella spp.
EIEADPAKLADEAGT

SEQ ID NO: 760 - protein, 8 aa, Brucella spp.
AGGQKKLA

SEQ ID NO: 761 - protein, 7 aa, Brucella spp.
AAEPPQE

SEQ ID NO: 762 - protein, 17 aa, Brucella spp.
LKKGAGLRSAVENASAG

SEQ ID NO: 763 - protein, 7 aa, Brucella spp.
DDARGID

SEQ ID NO: 764 - protein, 11 aa, Brucella spp.
LGGDRLATRGE

SEQ ID NO: 765 - protein, 5 aa, Brucella spp.
KERID

SEQ ID NO: 766 - protein, 6 aa, Brucella spp.
GLSTDE

SEQ ID NO: 767 - protein, 5 aa, Brucella spp.
KSGTA

SEQ ID NO: 768 - protein, 8 aa, Brucella spp.
DTERKSAS

SEQ ID NO: 769 - protein, 5 aa, Brucella spp.
SRRNA

SEQ ID NO: 770 - protein, 14 aa, Brucella spp.
SPAPQSGTRSAGDT

SEQ ID NO: 771 - protein, 7 aa, Brucella spp.
EELGADG

SEQ ID NO: 772 - protein, 7 aa, Brucella spp.
AKTSRIE

SEQ ID NO: 773 - protein, 5 aa, Brucella spp.
GAADL

SEQ ID NO: 774 - protein, 8 aa, Brucella spp.
SRGSPEQV

SEQ ID NO: 775 - protein, 13 aa, Brucella spp.
KPEEGKTDADMGR

SEQ ID NO: 776 - protein, 16 aa, Brucella spp.
EGFAQPNPRPMFPNPP

SEQ ID NO: 777 - protein, 5 aa, Brucella spp.
HSDGL

SEQ ID NO: 778 - protein, 6 aa, Brucella spp.
SNATAQ

SEQ ID NO: 779 - protein, 13 aa, Brucella spp.
SSTLKDDETGEPF

SEQ ID NO: 780 - protein, 11 aa, Brucella spp.
EAGHTRTPRVS

SEQ ID NO: 781 - protein, 11 aa, Brucella spp.
FGNGGKEQDSI

SEQ ID NO: 782 - protein, 6 aa, Brucella spp.
YAAEPD

SEQ ID NO: 783 - protein, 6 aa, Brucella spp.
DEAIAE

SEQ ID NO: 784 - protein, 8 aa, Brucella spp.
VSSSSGLG

SEQ ID NO: 785 - protein, 11 aa, Brucella spp.
RFDETGHPQNI

SEQ ID NO: 786 - protein, 13 aa, Brucella spp.
GSYPSGPSSAEPP

SEQ ID NO: 787 - protein, 8 aa, Brucella spp.
AAARRPGV

SEQ ID NO: 788 - protein, 16 aa, Brucella spp.
PKRQGTAMNDKAREAP

SEQ ID NO: 789 - protein, 9 aa, Brucella spp.
TTADERGNL

SEQ ID NO: 790 - protein, 8 aa, Brucella spp.
HEGATLGG

SEQ ID NO: 791 - protein, 6 aa, Brucella spp.
AARNNG

SEQ ID NO: 792 - protein, 9 aa, Brucella spp.
AREGTLKPH

SEQ ID NO: 793 - protein, 10 aa, Brucella spp.
PDQKQTTQTL

SEQ ID NO: 794 - protein, 6 aa, Brucella spp.
LQAGSA

SEQ ID NO: 795 - protein, 7 aa, Brucella spp.
ADAYMPS

SEQ ID NO: 796 - protein, 6 aa, Brucella spp.
RDGSVN

SEQ ID NO: 797 - protein, 4 aa, Brucella spp.
AGAG

SEQ ID NO: 798 - protein, 11 aa, Brucella spp.
GPRGVEQGQDV

SEQ ID NO: 799 - protein, 5 aa, Brucella spp.
IGGAT

SEQ ID NO: 800 - protein, 5 aa, Brucella spp.
LAASG

SEQ ID NO: 801 - protein, 11 aa, Brucella spp.
LADRPENRDPR

SEQ ID NO: 802 - protein, 9 aa, Brucella spp.
SGAPFNPGN

SEQ ID NO: 803 - protein, 7 aa, Brucella spp.
NVGGNSK

SEQ ID NO: 804 - protein, 16 aa, Brucella spp.
LGDDPTEPHHSKPYPY

SEQ ID NO: 805 - protein, 4 aa, Brucella spp.
DERP

SEQ ID NO: 806 - protein, 4 aa, Brucella spp.
GLHP

SEQ ID NO: 807 - protein, 6 aa, Brucella spp.
RTPWDA

SEQ ID NO: 808 - protein, 12 aa, Brucella spp.
PNCDDGKMDAET

SEQ ID NO: 809 - protein, 5 aa, Brucella spp.
ETSAQ

SEQ ID NO: 810 - protein, 9 aa, Brucella spp.
LEAGPDGKA

SEQ ID NO: 811 - protein, 9 aa, Brucella spp.
LANRSDQVG

SEQ ID NO: 812 - protein, 5 aa, Brucella spp.
YRNDS

SEQ ID NO: 813 - protein, 9 aa, Brucella spp.
DGAGGPPLG

SEQ ID NO: 814 - protein, 12 aa, Brucella spp.
DLPSPESRVSVD

SEQ ID NO: 815 - protein, 24 aa, Brucella spp.
DRRTPSHQCGTARIGNDPATAPLD

SEQ ID NO: 816 - protein, 5 aa, Brucella spp.
TSSGD

SEQ ID NO: 817 - protein, 8 aa, Brucella spp.
ANTGATDI

SEQ ID NO: 818 - protein, 9 aa, Brucella spp.
KGKTFNADT

SEQ ID NO: 819 - protein, 4 aa, Brucella spp.
DQKL

SEQ ID NO: 820 - protein, 7 aa, Brucella spp.
KSGESVK

SEQ ID NO: 821 - protein, 7 aa, Brucella spp.
AGSDKSI

SEQ ID NO: 822 - protein, 4 aa, Brucella spp.
RNFR

SEQ ID NO: 823 - protein, 8 aa, Brucella spp.
AEEGGAGG

SEQ ID NO: 824 - protein, 11 aa, Brucella spp.
RGGHAAQPHRT

SEQ ID NO: 825 - protein, 6 aa, Brucella spp.
RNTDPL

SEQ ID NO: 826 - protein, 8 aa, Brucella spp.
AKLSGTVR

SEQ ID NO: 827 - protein, 6 aa, Brucella spp.
KETRAF

SEQ ID NO: 828 - protein, 4 aa, Brucella spp.
RETA

SEQ ID NO: 829 - protein, 8 aa, Brucella spp.
IAAATGAE

SEQ ID NO: 830 - protein, 5 aa, Brucella spp.
AQTEF

SEQ ID NO: 831 - protein, 11 aa, Brucella spp.
VAGEGKVDTNI

SEQ ID NO: 832 - protein, 7 aa, Brucella spp.
GDTPGLH

SEQ ID NO: 833 - protein, 10 aa, Brucella spp.
AQEQGSVEMG

SEQ ID NO: 834 - protein, 9 aa, Brucella spp.
LEKRSADAL

SEQ ID NO: 835 - protein, 6 aa, Brucella spp.
ARHPDR

SEQ ID NO: 836 - protein, 8 aa, Brucella spp.
RKFANDEA

SEQ ID NO: 837 - protein, 10 aa, Brucella spp.
QEKGSDTKTR

SEQ ID NO: 838 - protein, 9 aa, Brucella spp.
GSARPEGYR

SEQ ID NO: 839 - protein, 21 aa, Brucella spp.
GAYPGVSAEERGQAEAIARST

SEQ ID NO: 840 - protein, 7 aa, Brucella spp.
EGGSGGA

SEQ ID NO: 841 - protein, 5 aa, Brucella spp.
SPEGA

SEQ ID NO: 842 - protein, 10 aa, Brucella spp.
TRAKDAASNM

SEQ ID NO: 843 - protein, 16 aa, Brucella spp.
EPLGGAHRGKESVIDA

SEQ ID NO: 844 - protein, 22 aa, Brucella spp.
DIDGETLKQERRQKFLEIGRNI

SEQ ID NO: 845 - protein, 12 aa, Brucella spp.
ERGAAQNTLESY

SEQ ID NO: 846 - protein, 8 aa, Brucella spp.
AAAEELAA

SEQ ID NO: 847 - protein, 7 aa, Brucella spp.
LAEAETG

SEQ ID NO: 848 - protein, 10 aa, Brucella spp.
GFAPTSQARR

SEQ ID NO: 849 - protein, 8 aa, Brucella spp.
FRQDDPTG

SEQ ID NO: 850 - protein, 7 aa, Brucella spp.
KKQKPLP

SEQ ID NO: 851 - protein, 11 aa, Brucella spp.
EANEAAEPGER

SEQ ID NO: 852 - protein, 7 aa, Brucella spp.
KGSKDRM

SEQ ID NO: 853 - protein, 5 aa, Brucella spp.
KARDA

SEQ ID NO: 854 - protein, 8 aa, Brucella spp.
SLPGSDDN

SEQ ID NO: 855 - protein, 12 aa, Brucella spp.
AARAGLAASSVS

SEQ ID NO: 856 - protein, 4 aa, Brucella spp.
RQTE

SEQ ID NO: 857 - protein, 8 aa, Brucella spp.
GKSTIGRK

SEQ ID NO: 858 - protein, 6 aa, Brucella spp.
ADTEIE

SEQ ID NO: 859 - protein, 5 aa, Brucella spp.
GGGAY

SEQ ID NO: 860 - protein, 6 aa, Brucella spp.
RRQNRP

SEQ ID NO: 861 - protein, 7 aa, Brucella spp.
NSDPRGV

SEQ ID NO: 862 - protein, 6 aa, Brucella spp.
DEKKEV

SEQ ID NO: 863 - protein, 8 aa, Brucella spp.
ERAGEEVA

SEQ ID NO: 864 - protein, 6 aa, Brucella spp.
AGIDST

SEQ ID NO: 865 - protein, 9 aa, Brucella spp.
PGEKSKSFA

SEQ ID NO: 866 - protein, 4 aa, Brucella spp.
ERGD

SEQ ID NO: 867 - protein, 15 aa, Brucella spp.
DSSVGGKTGINTAHG

SEQ ID NO: 868 - protein, 4 aa, Brucella spp.
PREF

SEQ ID NO: 869 - protein, 9 aa, Brucella spp.
GGAARTKAI

SEQ ID NO: 870 - protein, 6 aa, Brucella spp.
AESCRS

SEQ ID NO: 871 - protein, 9 aa, Brucella spp.
RDERETGDR

SEQ ID NO: 872 - protein, 8 aa, Brucella spp.
SATGYDSS

SEQ ID NO: 873 - protein, 9 aa, Brucella spp.
VPGGLPPAE

SEQ ID NO: 874 - protein, 6 aa, Brucella spp.
KKVTRG

SEQ ID NO: 875 - protein, 5 aa, Brucella spp.
DVPPA

SEQ ID NO: 876 - protein, 18 aa, Brucella spp.
HHRDGGHEDDTYDGAGET

SEQ ID NO: 877 - protein, 12 aa, Brucella spp.
PKKTTEAKSSAP

SEQ ID NO: 878 - protein, 9 aa, Brucella spp.
DKPGTHRAP

SEQ ID NO: 879 - protein, 5 aa, Brucella spp.
SDGDI

SEQ ID NO: 880 - protein, 25 aa, Brucella spp.
AITGHRPTWSTAANSTAKVRTSPDM

SEQ ID NO: 881 - protein, 10 aa, Brucella spp.
MRSGSASYHN

SEQ ID NO: 882 - protein, 16 aa, Brucella spp.
KGHAPGQKAQRKPRTL

SEQ ID NO: 883 - protein, 12 aa, Brucella spp.
DANSTGDKIKAR

SEQ ID NO: 884 - protein, 13 aa, Brucella spp.
PDANGGDRGSEER

SEQ ID NO: 885 - protein, 4 aa, Brucella spp.
ARGR

SEQ ID NO: 886 - protein, 10 aa, Brucella spp.
VKGSEPGIRS

SEQ ID NO: 887 - protein, 15 aa, Brucella spp.
AVPRPRGPCHPAGRS

SEQ ID NO: 888 - protein, 5 aa, Brucella spp.
PDTTV

SEQ ID NO: 889 - protein, 9 aa, Brucella spp.
AGDSYVPEL

SEQ ID NO: 890 - protein, 10 aa, Brucella spp.
HGTGKSTHIE

SEQ ID NO: 891 - protein, 5 aa, Brucella spp.
DAGRP

SEQ ID NO: 892 - protein, 8 aa, Brucella spp.
VGLGDTTG

SEQ ID NO: 893 - protein, 5 aa, Brucella spp.
QINQA

SEQ ID NO: 894 - protein, 9 aa, Brucella spp.
HYQNAEGRE

SEQ ID NO: 895 - protein, 10 aa, Brucella spp.
KTGPVDSEPF

SEQ ID NO: 896 - protein, 21 aa, Brucella spp.
RPALSANRARLPDLPKRPTAH

SEQ ID NO: 897 - protein, 4 aa, Brucella spp.
RHNP

SEQ ID NO: 898 - protein, 8 aa, Brucella spp.
APEGKQAR

SEQ ID NO: 899 - protein, 5 aa, Brucella spp.
YSRAN

SEQ ID NO: 900 - protein, 11 aa, Brucella spp.
AVTTKEDAPLE

SEQ ID NO: 901 - protein, 10 aa, Brucella spp.
TGRPAPAEAG

SEQ ID NO: 902 - protein, 7 aa, Brucella spp.
KASADIA

SEQ ID NO: 903 - protein, 7 aa, Brucella spp.
ENLEDQQ

SEQ ID NO: 904 - protein, 85 aa, Brucella spp.
LSQEEPSDDEEQNDEQTPDSDENEEGGDENQEGSDSAESEESDSSSDEGEQGEMDAADASADEMDDSEDIDAETPGDTRRPNQPF

SEQ ID NO: 905 - protein, 5 aa, Brucella spp.
EEVEA

SEQ ID NO: 906 - protein, 15 aa, Brucella spp.
TQPLSYKQERDTDFR

SEQ ID NO: 907 - protein, 8 aa, Brucella spp.
SGSMRGRP

SEQ ID NO: 908 - protein, 10 aa, Brucella spp.
AWKGGQSREA

SEQ ID NO: 909 - protein, 10 aa, Brucella spp.
RGKPANPGRL

SEQ ID NO: 910 - protein, 7 aa, Brucella spp.
ADAPWRR

SEQ ID NO: 911 - protein, 5 aa, Brucella spp.
GRPEQ

SEQ ID NO: 912 - protein, 15 aa, Brucella spp.
GAPVDDSTLSVNPGN

SEQ ID NO: 913 - protein, 5 aa, Brucella spp.
ETRSP

SEQ ID NO: 914 - protein, 17 aa, Brucella spp.
EQGAAASVRGRRRAGRR

SEQ ID NO: 915 - protein, 4 aa, Brucella spp.
GGGG

SEQ ID NO: 916 - protein, 9 aa, Brucella spp.
ILGGGGGAR

SEQ ID NO: 917 - protein, 8 aa, Brucella spp.
AEMGGGGG

SEQ ID NO: 918 - protein, 29 aa, Brucella spp.
VSGGSGGTPKSTGDYTKGQVPEGSPGGGV

SEQ ID NO: 919 - protein, 10 aa, Brucella spp.
TVNLSSTGSI

SEQ ID NO: 920 - protein, 11 aa, Brucella spp.
ISTPKMKSPPA

SEQ ID NO: 921 - protein, 8 aa, Brucella spp.
DSVINNQG

SEQ ID NO: 922 - protein, 12 aa, Brucella spp.
INNGQFASTSEA

SEQ ID NO: 923 - protein, 7 aa, Brucella spp.
FDGNDNT

SEQ ID NO: 924 - protein, 7 aa, Brucella spp.
TGGGTGN

SEQ ID NO: 925 - protein, 4 aa, Brucella spp.
NAGT

SEQ ID NO: 926 - protein, 10 aa, Brucella spp.
IDPGSENRQQ

SEQ ID NO: 927 - protein, 17 aa, Brucella spp.
NGTSTWSGSGASMATGP

SEQ ID NO: 928 - protein, 10 aa, Brucella spp.
LTDDGSLASH

SEQ ID NO: 929 - protein, 21 aa, Brucella spp.
GITNSTTMQNLSGPANSTINL

SEQ ID NO: 930 - protein, 8 aa, Brucella spp.
KNTTTQTF

SEQ ID NO: 931 - protein, 10 aa, Brucella spp.
ASGAGGNIEL

SEQ ID NO: 932 - protein, 13 aa, Brucella spp.
DNTYTGTSTIAAG

SEQ ID NO: 933 - protein, 10 aa, Brucella spp.
LGTGGTIGSI

SEQ ID NO: 934 - protein, 6 aa, Brucella spp.
SDAAVN

SEQ ID NO: 935 - protein, 7 aa, Brucella spp.
SGTGSIQ

SEQ ID NO: 936 - protein, 14 aa, Brucella spp.
SGNSDTYTGSTSVD

SEQ ID NO: 937 - protein, 11 aa, Brucella spp.
GGTSLAGTGTI

SEQ ID NO: 938 - protein, 6 aa, Brucella spp.
TTIADG

SEQ ID NO: 939 - protein, 7 aa, Brucella spp.
KAPNAPG

SEQ ID NO: 940 - protein, 7 aa, Brucella spp.
GTRSGNL

SEQ ID NO: 941 - protein, 9 aa, Brucella spp.
SVPTGTDPS

SEQ ID NO: 942 - protein, 5 aa, Brucella spp.
TTPNQ

SEQ ID NO: 943 - protein, 17 aa, Brucella spp.
GNSADHDNGAVDGGDGV

SEQ ID NO: 944 - protein, 10 aa, Brucella spp.
KLSGADNGSW

SEQ ID NO: 945 - protein, 4 aa, Brucella spp.
TVTI

SEQ ID NO: 946 - protein, 5 aa, Brucella spp.
NPITI

SEQ ID NO: 947 - protein, 10 aa, Brucella spp.
GDGSRAGAAM

SEQ ID NO: 948 - protein, 10 aa, Brucella spp.
ESEIKGNQGL

SEQ ID NO: 949 - protein, 15 aa, Brucella spp.
GTNSYTGTTTVGEGT

SEQ ID NO: 950 - protein, 11 aa, Brucella spp.
GNGTATGSIPG

SEQ ID NO: 951 - protein, 5 aa, Brucella spp.
NSYGY

SEQ ID NO: 952 - protein, 29 aa, Brucella spp.
SSISGGGKVVQKGSGTTTFTGNNTYSGGL

SEQ ID NO: 953 - protein, 11 aa, Brucella spp.
VEQGTAEAGIA

SEQ ID NO: 954 - protein, 18 aa, Brucella spp.
DNAFGSGPLTVQAGAKAD

SEQ ID NO: 955 - protein, 7 aa, Brucella spp.
VTLGSGT

SEQ ID NO: 956 - protein, 15 aa, Brucella spp.
SGDGGLNKSGAGQLT

SEQ ID NO: 957 - protein, 12 aa, Brucella spp.
GANTYGGATTID

SEQ ID NO: 958 - protein, 21 aa, Brucella spp.
GESGAFSSSSAYRTGASGTVD

SEQ ID NO: 959 - protein, 5 aa, Brucella spp.
DDNSL

SEQ ID NO: 960 - protein, 9 aa, Brucella spp.
EGNTSGTTS

SEQ ID NO: 961 - protein, 5 aa, Brucella spp.
GMQTA

SEQ ID NO: 962 - protein, 8 aa, Brucella spp.
TTADKQQA

SEQ ID NO: 963 - protein, 5 aa, Brucella spp.
SVDNL

SEQ ID NO: 964 - protein, 15 aa, Brucella spp.
KDTPTPTPTPQPQFN

SEQ ID NO: 965 - protein, 26 aa, Brucella spp.
WNGPSYPAIEQGGAPAGADPASSPVA

SEQ ID NO: 966 - protein, 14 aa, Brucella spp.
DYSKLQSSRSLTNM

SEQ ID NO: 967 - protein, 5 aa, Brucella spp.
YEADT

SEQ ID NO: 968 - protein, 17 aa, Brucella spp.
RINSPSGDGDATTSAWG

SEQ ID NO: 969 - protein, 21 aa, Brucella spp.
DYNSDTAGKGLADDKKATGYA

SEQ ID NO: 970 - protein, 9 aa, Brucella spp.
SLNDSDSLI

SEQ ID NO: 971 - protein, 6 aa, Brucella spp.
WQDDAG

SEQ ID NO: 972 - protein, 4 aa, Brucella spp.
INTS

SEQ ID NO: 973 - protein, 7 aa, Brucella spp.
SSPAGSQ

SEQ ID NO: 974 - protein, 14 aa, Brucella spp.
YDGNGNDAPKPGTD

SEQ ID NO: 975 - protein, 28 aa, Brucella spp.
NPNGNVKVASGSSLDAAITQDSANPNVY

SEQ ID NO: 976 - protein, 12 aa, Brucella spp.
SASGNKTGDSTQ

SEQ ID NO: 977 - protein, 7 aa, Brucella spp.
NPSPALQ

SEQ ID NO: 978 - protein, 13 aa, Brucella spp.
SPVPGTPDSDATL

SEQ ID NO: 979 - protein, 13 aa, Brucella spp.
VTDEGGNPIPDSS

SEQ ID NO: 980 - protein, 9 aa, Brucella spp.
RKTSATQTG

SEQ ID NO: 981 - protein, 6 aa, Brucella spp.
SKTPIS

SEQ ID NO: 982 - protein, 18 aa, Brucella spp.
LTPQDPRSDSRFAQATNK

SEQ ID NO: 983 - protein, 5 aa, Brucella spp.
NQNPG

SEQ ID NO: 984 - protein, 4 aa, Brucella spp.
TIRG

SEQ ID NO: 985 - protein, 20 aa, Brucella spp.
ELEAPDTDIGPDLSNYTDTT

SEQ ID NO: 986 - protein, 8 aa, Brucella spp.
NKNTSPNE

SEQ ID NO: 987 - protein, 4 aa, Brucella spp.
NQIA

SEQ ID NO: 988 - protein, 11 aa, Brucella spp.
GTNLNENGSAL

SEQ ID NO: 989 - protein, 13 aa, Brucella spp.
LNVGSSSAKPQNN

SEQ ID NO: 990 - protein, 8 aa, Brucella spp.
SNGDLINS

SEQ ID NO: 991 - protein, 9 aa, Brucella spp.
LPTPNPENQ

SEQ ID NO: 992 - protein, 5 aa, Brucella spp.
DPNGG

SEQ ID NO: 993 - protein, 9 aa, Brucella spp.
GNPTDYTTT

SEQ ID NO: 994 - protein, 8 aa, Brucella spp.
KDKTTLAD

SEQ ID NO: 995 - protein, 8 aa, Brucella spp.
GDFQSDDN

SEQ ID NO: 996 - protein, 7 aa, Brucella spp.
ITDPTDS

SEQ ID NO: 997 - protein, 13 aa, Brucella spp.
SGYGTPKDPKRSN

SEQ ID NO: 998 - protein, 23 aa, Brucella spp.
PASATTPIAASSLTQGVLSTRVI

SEQ ID NO: 999 - protein, 8 aa, Brucella spp.
LDTTQSPP

SEQ ID NO: 1000 - protein, 4 aa, Brucella spp.
RTDQ

SEQ ID NO: 1001 - protein, 21 aa, Brucella spp.
QPIEAQDPTGPTPRLGKPPQF

SEQ ID NO: 1002 - protein, 7 aa, Brucella spp.
FSAGNEY

SEQ ID NO: 1003 - protein, 5 aa, Brucella spp.
DSLEK

SEQ ID NO: 1004 - protein, 9 aa, Brucella spp.
EGAAGYTDD

SEQ ID NO: 1005 - protein, 6 aa, Brucella spp.
QGPPNM

SEQ ID NO: 1006 - protein, 6 aa, Brucella spp.
ARGRGK

SEQ ID NO: 1007 - protein, 9 aa, Brucella spp.
VTDPNLSSA

SEQ ID NO: 1008 - protein, 7 aa, Brucella spp.
IDTSSDD

SEQ ID NO: 1009 - protein, 4 aa, Brucella spp.
PNLP

SEQ ID NO: 1010 - protein, 8 aa, Brucella spp.
SAEKPGTY

SEQ ID NO: 1011 - protein, 9 aa, Brucella spp.
GPSGAGKTS

SEQ ID NO: 1012 - protein, 8 aa, Brucella spp.
GKEEATYR

SEQ ID NO: 1013 - protein, 9 aa, Brucella spp.
SGGEKQRAA

SEQ ID NO: 1014 - protein, 11 aa, Brucella spp.
DEPTGNVDPPL

SEQ ID NO: 1015 - protein, 5 aa, Brucella spp.
NRSGT

SEQ ID NO: 1016 - protein, 5 aa, Brucella spp.
PPEDV

SEQ ID NO: 1017 - protein, 5 aa, Brucella spp.
GGQPI

SEQ ID NO: 1018 - protein, 7 aa, Brucella spp.
SEDGDPI

SEQ ID NO: 1019 - protein, 8 aa, Brucella spp.
DNSGKDEK

SEQ ID NO: 1020 - protein, 4 aa, Brucella spp.
LEPG

SEQ ID NO: 1021 - protein, 6 aa, Brucella spp.
WGDEDY

SEQ ID NO: 1022 - protein, 7 aa, Brucella spp.
RGTPDHP

SEQ ID NO: 1023 - protein, 4 aa, Brucella spp.
TGGS

SEQ ID NO: 1024 - protein, 7 aa, Brucella spp.
GRMTSEK

SEQ ID NO: 1025 - protein, 10 aa, Brucella spp.
SAQGESGANI

SEQ ID NO: 1026 - protein, 4 aa, Brucella spp.
ADTE

SEQ ID NO: 1027 - protein, 9 aa, Brucella spp.
WPSAEKSTT

SEQ ID NO: 1028 - protein, 6 aa, Brucella spp.
PLPDSS

SEQ ID NO: 1029 - protein, 7 aa, Brucella spp.
ENAQETL

SEQ ID NO: 1030 - protein, 11 aa, Brucella spp.
PFGSGRPYSRT

SEQ ID NO: 1031 - protein, 7 aa, Brucella spp.
VSQRSSR

SEQ ID NO: 1032 - protein, 7 aa, Brucella spp.
PRGTPVS

SEQ ID NO: 1033 - protein, 11 aa, Brucella spp.
RHEPASRVDRN

SEQ ID NO: 1034 - protein, 9 aa, Brucella spp.
PRKRAARPF

SEQ ID NO: 1035 - protein, 5 aa, Brucella spp.
PEQGF

SEQ ID NO: 1036 - protein, 7 aa, Brucella spp.
LGRGGGI

SEQ ID NO: 1037 - protein, 4 aa, Brucella spp.
GVEP

SEQ ID NO: 1038 - protein, 9 aa, Brucella spp.
YGKGTTSTE

SEQ ID NO: 1039 - protein, 5 aa, Brucella spp.
SDVRD

SEQ ID NO: 1040 - protein, 7 aa, Brucella spp.
KANSNQA

SEQ ID NO: 1041 - protein, 13 aa, Brucella spp.
LGAGADTVSQGEI

SEQ ID NO: 1042 - protein, 6 aa, Brucella spp.
GKTPRE

SEQ ID NO: 1043 - protein, 4 aa, Brucella spp.
SEPE

SEQ ID NO: 1044 - protein, 5 aa, Brucella spp.
AAGKV

SEQ ID NO: 1045 - protein, 33 aa, Brucella spp.
PDVDAKTHAKISTGKSENKFGIPRDKARAAYAR

SEQ ID NO: 1046 - protein, 4 aa, Brucella spp.
ASLP

SEQ ID NO: 1047 - protein, 5 aa, Brucella spp.
QADGH

SEQ ID NO: 1048 - protein, 12 aa, Brucella spp.
YRTPNTPPPPPV

SEQ ID NO: 1049 - protein, 4 aa, Brucella spp.
GDAK

SEQ ID NO: 1050 - protein, 6 aa, Brucella spp.
DNAPRI

SEQ ID NO: 1051 - protein, 8 aa, Brucella spp.
VAKPAPGD

SEQ ID NO: 1052 - protein, 6 aa, Brucella spp.
ASGPDA

SEQ ID NO: 1053 - protein, 7 aa, Brucella spp.
HKQIENG

SEQ ID NO: 1054 - protein, 9 aa, Brucella spp.
TARSRNDQV

SEQ ID NO: 1055 - protein, 6 aa, Brucella spp.
LEKTAA

SEQ ID NO: 1056 - protein, 7 aa, Brucella spp.
DESPLGA

SEQ ID NO: 1057 - protein, 6 aa, Brucella spp.
LAGTGF

SEQ ID NO: 1058 - protein, 16 aa, Brucella spp.
FREPTRNSLDSVSDRD

SEQ ID NO: 1059 - protein, 19 aa, Brucella spp.
AFSTGSSIMPQKKNPDAAE

SEQ ID NO: 1060 - protein, 7 aa, Brucella spp.
KTGRING

SEQ ID NO: 1061 - protein, 9 aa, Brucella spp.
KDMQEDKEQ

SEQ ID NO: 1062 - protein, 12 aa, Brucella spp.
KAAGSGYSTATD

SEQ ID NO: 1063 - protein, 16 aa, Brucella spp.
SVKSRQSFGGTAPQEV

SEQ ID NO: 1064 - protein, 14 aa, Brucella spp.
GDKGTTGLASGPRR

SEQ ID NO: 1065 - protein, 5 aa, Brucella spp.
GTVDE

SEQ ID NO: 1066 - protein, 8 aa, Brucella spp.
TGAQDAHA

SEQ ID NO: 1067 - protein, 12 aa, Brucella spp.
DLSTPDDGQPLS

SEQ ID NO: 1068 - protein, 7 aa, Brucella spp.
GGSPASA

SEQ ID NO: 1069 - protein, 9 aa, Brucella spp.
EGEKVSPEA

SEQ ID NO: 1070 - protein, 7 aa, Brucella spp.
VNDNGAS

SEQ ID NO: 1071 - protein, 16 aa, Brucella spp.
QSLSERGGSVLERVSI

SEQ ID NO: 1072 - protein, 5 aa, Brucella spp.
QKRPL

SEQ ID NO: 1073 - protein, 10 aa, Brucella spp.
LSGGNPAIQP

SEQ ID NO: 1074 - protein, 5 aa, Brucella spp.
GKAEG

SEQ ID NO: 1075 - protein, 5 aa, Brucella spp.
TQGSV

SEQ ID NO: 1076 - protein, 10 aa, Brucella spp.
SPKPPSSAME

SEQ ID NO: 1077 - protein, 8 aa, Brucella spp.
AAGTGPRT

SEQ ID NO: 1078 - protein, 4 aa, Brucella spp.
ARHP

SEQ ID NO: 1079 - protein, 15 aa, Brucella spp.
PGNHTPPPPDADDAA

SEQ ID NO: 1080 - protein, 4 aa, Brucella spp.
LTGL

SEQ ID NO: 1081 - protein, 5 aa, Brucella spp.
APDLD

SEQ ID NO: 1082 - protein, 8 aa, Brucella spp.
HEQTTAER

SEQ ID NO: 1083 - protein, 42 aa, Brucella spp.
AKHRRPGRNTGPENHDETRNETCNETRPRNPHQRDFRPDHSR

SEQ ID NO: 1084 - protein, 9 aa, Brucella spp.
VKGDGSGVE

SEQ ID NO: 1085 - protein, 4 aa, Brucella spp.
AGKV

SEQ ID NO: 1086 - protein, 9 aa, Brucella spp.
GPAQAQETL

SEQ ID NO: 1087 - protein, 6 aa, Brucella spp.
DETVEP

SEQ ID NO: 1088 - protein, 5 aa, Brucella spp.
EAEKP

SEQ ID NO: 1089 - protein, 11 aa, Brucella spp.
AIDDDSNQTGQ

SEQ ID NO: 1090 - protein, 17 aa, Brucella spp.
ELGEGSAKVTREVDGGL

SEQ ID NO: 1091 - protein, 4 aa, Brucella spp.
QPRY

SEQ ID NO: 1092 - protein, 14 aa, Brucella spp.
KKKPLDEKSPADFG

SEQ ID NO: 1093 - protein, 13 aa, Brucella spp.
TEEPGGRKAGVKV

SEQ ID NO: 1094 - protein, 19 aa, Brucella spp.
ATLSDQTAKALTAAAQIGG

SEQ ID NO: 1095 - protein, 15 aa, Brucella spp.
GKGAKAAADAAAKLK

SEQ ID NO: 1096 - protein, 6 aa, Brucella spp.
RLAEPT

SEQ ID NO: 1097 - protein, 8 aa, Brucella spp.
PATTSAKN

SEQ ID NO: 1098 - protein, 8 aa, Brucella spp.
TVQSTDAK

SEQ ID NO: 1099 - protein, 23 aa, Brucella spp.
FQATGEGGSASVESVNAPADPAL

SEQ ID NO: 1100 - protein, 10 aa, Brucella spp.
LSGGDRPELT

SEQ ID NO: 1101 - protein, 8 aa, Brucella spp.
RALGSAEK

SEQ ID NO: 1102 - protein, 18 aa, Brucella spp.
AAVGASRAAVDAGYAPND

SEQ ID NO: 1103 - protein, 7 aa, Brucella spp.
VGQTGKV

SEQ ID NO: 1104 - protein, 6 aa, Brucella spp.
KDEEAP

SEQ ID NO: 1105 - protein, 6 aa, Brucella spp.
AAGRGR

SEQ ID NO: 1106 - protein, 5 aa, Brucella spp.
RENGV

SEQ ID NO: 1107 - protein, 9 aa, Brucella spp.
KQGKAVPGK

SEQ ID NO: 1108 - protein, 8 aa, Brucella spp.
EPTSGNTG

SEQ ID NO: 1109 - protein, 8 aa, Brucella spp.
GAKGMKGA

SEQ ID NO: 1110 - protein, 9 aa, Brucella spp.
AIAEGNPNA

SEQ ID NO: 1111 - protein, 7 aa, Brucella spp.
ENPANPE

SEQ ID NO: 1112 - protein, 7 aa, Brucella spp.
NDTNGEA

SEQ ID NO: 1113 - protein, 8 aa, Brucella spp.
GTGGTITG

SEQ ID NO: 1114 - protein, 4 aa, Brucella spp.
RKPS

SEQ ID NO: 1115 - protein, 18 aa, Brucella spp.
EPKDSPVLSGGAPGPHKI

SEQ ID NO: 1116 - protein, 9 aa, Brucella spp.
GFAPKTLDT

SEQ ID NO: 1117 - protein, 5 aa, Brucella spp.
EDAFT

SEQ ID NO: 1118 - protein, 4 aa, Brucella spp.
SGAA

SEQ ID NO: 1119 - protein, 9 aa, Brucella spp.
GKRSENAGK

SEQ ID NO: 1120 - protein, 9 aa, Brucella spp.
SELSEGAVK

SEQ ID NO: 1121 - protein, 5 aa, Brucella spp.
AEDGR

SEQ ID NO: 1122 - protein, 9 aa, Brucella spp.
RKEPPAGVG

SEQ ID NO: 1123 - protein, 4 aa, Brucella spp.
PNSE

SEQ ID NO: 1124 - protein, 5 aa, Brucella spp.
EGAES

SEQ ID NO: 1125 - protein, 6 aa, Brucella spp.
LYGGTE

SEQ ID NO: 1126 - protein, 10 aa, Brucella spp.
EKAAEEALAK

SEQ ID NO: 1127 - protein, 7 aa, Brucella spp.
PANPTNS

SEQ ID NO: 1128 - protein, 9 aa, Brucella spp.
IEARQGSRP

SEQ ID NO: 1129 - protein, 8 aa, Brucella spp.
RADSNARA

SEQ ID NO: 1130 - protein, 4 aa, Brucella spp.
ERSD

SEQ ID NO: 1131 - protein, 7 aa, Brucella spp.
CTGAGST

SEQ ID NO: 1132 - protein, 5 aa, Brucella spp.
KGGQA

SEQ ID NO: 1133 - protein, 12 aa, Brucella spp.
LGGTESLASHPA

SEQ ID NO: 1134 - protein, 11 aa, Brucella spp.
RREQDSLGERD

SEQ ID NO: 1135 - protein, 7 aa, Brucella spp.
AAATANY

SEQ ID NO: 1136 - protein, 5 aa, Brucella spp.
LPEPK

SEQ ID NO: 1137 - protein, 11 aa, Brucella spp.
GGAGTSSNMNA

SEQ ID NO: 1138 - protein, 14 aa, Brucella spp.
GRPRGDYQTIHPND

SEQ ID NO: 1139 - protein, 12 aa, Brucella spp.
VNMSQSTNDVYP

SEQ ID NO: 1140 - protein, 4 aa, Brucella spp.
KGRE

SEQ ID NO: 1141 - protein, 7 aa, Brucella spp.
REDTARL

SEQ ID NO: 1142 - protein, 7 aa, Brucella spp.
GTAIGTR

SEQ ID NO: 1143 - protein, 9 aa, Brucella spp.
SSGPRSGLG

SEQ ID NO: 1144 - protein, 9 aa, Brucella spp.
VQPGSSIMP

SEQ ID NO: 1145 - protein, 5 aa, Brucella spp.
ESGQL

SEQ ID NO: 1146 - protein, 8 aa, Brucella spp.
RAGAEESI

SEQ ID NO: 1147 - protein, 7 aa, Brucella spp.
QALASGQ

SEQ ID NO: 1148 - protein, 4 aa, Brucella spp.
GLDA

SEQ ID NO: 1149 - protein, 15 aa, Brucella spp.
PPETHDKEAHHASVG

SEQ ID NO: 1150 - protein, 9 aa, Brucella spp.
GSSNDRRVK

SEQ ID NO: 1151 - protein, 6 aa, Brucella spp.
RQRAEQ

SEQ ID NO: 1152 - protein, 15 aa, Brucella spp.
YENLTDEQLQAKTAE

SEQ ID NO: 1153 - protein, 5 aa, Brucella spp.
EGKSL

SEQ ID NO: 1154 - protein, 6 aa, Brucella spp.
TAREAA

SEQ ID NO: 1155 - protein, 8 aa, Brucella spp.
MRTGEGKT

SEQ ID NO: 1156 - protein, 7 aa, Brucella spp.
TRDAETM

SEQ ID NO: 1157 - protein, 9 aa, Brucella spp.
LDDDERRAA

SEQ ID NO: 1158 - protein, 6 aa, Brucella spp.
YGTNNE

SEQ ID NO: 1159 - protein, 5 aa, Brucella spp.
LEDRS

SEQ ID NO: 1160 - protein, 11 aa, Brucella spp.
EDYEVDEKQKT

SEQ ID NO: 1161 - protein, 4 aa, Brucella spp.
GTEK

SEQ ID NO: 1162 - protein, 4 aa, Brucella spp.
LKGE

SEQ ID NO: 1163 - protein, 4 aa, Brucella spp.
YSEG

SEQ ID NO: 1164 - protein, 7 aa, Brucella spp.
IQPENQT

SEQ ID NO: 1165 - protein, 13 aa, Brucella spp.
GMTGTAATEAEEF

SEQ ID NO: 1166 - protein, 6 aa, Brucella spp.
DEDDEV

SEQ ID NO: 1167 - protein, 8 aa, Brucella spp.
ASHEKGQP

SEQ ID NO: 1168 - protein, 9 aa, Brucella spp.
SIEKSEQLA

SEQ ID NO: 1169 - protein, 4 aa, Brucella spp.
VPGA

SEQ ID NO: 1170 - protein, 9 aa, Brucella spp.
MAGRGTDIQ

SEQ ID NO: 1171 - protein, 12 aa, Brucella spp.
SDVPEGPEREEK

SEQ ID NO: 1172 - protein, 4 aa, Brucella spp.
ALAA

SEQ ID NO: 1173 - protein, 7 aa, Brucella spp.
RHESRRI

SEQ ID NO: 1174 - protein, 15 aa, Brucella spp.
QLRGRSGRQGDPGRS

SEQ ID NO: 1175 - protein, 10 aa, Brucella spp.
EKAQKKVEAR

SEQ ID NO: 1176 - protein, 5 aa, Brucella spp.
DLTET

SEQ ID NO: 1177 - protein, 4 aa, Brucella spp.
DAYA

SEQ ID NO: 1178 - protein, 8 aa, Brucella spp.
EEGIAEEE

SEQ ID NO: 1179 - protein, 16 aa, Brucella spp.
KEAADKAAAEKAERFG

SEQ ID NO: 1180 - protein, 9 aa, Brucella spp.
QRDPLNEYK

SEQ ID NO: 1181 - protein, 10 aa, Brucella spp.
EAPPEPQLPP

SEQ ID NO: 1182 - protein, 8 aa, Brucella spp.
GATGENDF

SEQ ID NO: 1183 - protein, 14 aa, Brucella spp.
VPPAQRDPADPRTW

SEQ ID NO: 1184 - protein, 22 aa, Brucella spp.
SRNEPCPCGSGKKYKHCHGAFE

SEQ ID NO: 1185 - protein, 6 aa, Brucella spp.
IKYKGR

SEQ ID NO: 1186 - protein, 5 aa, Brucella spp.
PAEAA

SEQ ID NO: 1187 - protein, 25 aa, Brucella spp.
SGNANAFTGLKGREATQATAEAAAK

SEQ ID NO: 1188 - protein, 5 aa, Brucella spp.
GEPLD

SEQ ID NO: 1189 - protein, 6 aa, Brucella spp.
AESATE

SEQ ID NO: 1190 - protein, 8 aa, Brucella spp.
TDTYPKVA

SEQ ID NO: 1191 - protein, 4 aa, Brucella spp.
PIKA

SEQ ID NO: 1192 - protein, 6 aa, Brucella spp.
GVGSTF

SEQ ID NO: 1193 - protein, 9 aa, Brucella spp.
VDSDTSTSD

SEQ ID NO: 1194 - protein, 18 aa, Brucella spp.
TAAERGAPEITDAADKRL

SEQ ID NO: 1195 - protein, 7 aa, Brucella spp.
DGEGARK

SEQ ID NO: 1196 - protein, 10 aa, Brucella spp.
GAKSAASAKK

SEQ ID NO: 1197 - protein, 7 aa, Brucella spp.
VAGEDAN

SEQ ID NO: 1198 - protein, 9 aa, Brucella spp.
KAGEPADRD

SEQ ID NO: 1199 - protein, 18 aa, Brucella spp.
HQGERDPAYSEDATSAYM

SEQ ID NO: 1200 - protein, 4 aa, Brucella spp.
GRGK

SEQ ID NO: 1201 - protein, 16 aa, Brucella spp.
KEVEEKPAEQPAPDAV

SEQ ID NO: 1202 - protein, 12 aa, Brucella spp.
SAPDVTEAPVAE

SEQ ID NO: 1203 - protein, 23 aa, Brucella spp.
EPEPIKEPAAETIEKEKAEPEHP

SEQ ID NO: 1204 - protein, 8 aa, Brucella spp.
APAPESVV

SEQ ID NO: 1205 - protein, 36 aa, Brucella spp.
VEPEPEQPAIAKAPEAPLAEEAAAPRPEPVKPKKVK

SEQ ID NO: 1206 - protein, 19 aa, Brucella spp.
RAVEEAAEEVPAEVAPEPK

SEQ ID NO: 1207 - protein, 12 aa, Brucella spp.
LARSSSSLSDSI

SEQ ID NO: 1208 - protein, 7 aa, Brucella spp.
LDDDTLQ

SEQ ID NO: 1209 - protein, 13 aa, Brucella spp.
ASGHYGKDVPGEE

SEQ ID NO: 1210 - protein, 10 aa, Brucella spp.
NGTGKTTTIG

SEQ ID NO: 1211 - protein, 5 aa, Brucella spp.
KLTAG

SEQ ID NO: 1212 - protein, 8 aa, Brucella spp.
RTGSPVVS

SEQ ID NO: 1213 - protein, 8 aa, Brucella spp.
KLGADAAG

SEQ ID NO: 1214 - protein, 8 aa, Brucella spp.
KAKEAGSD

SEQ ID NO: 1215 - protein, 6 aa, Brucella spp.
GRLQNK

SEQ ID NO: 1216 - protein, 7 aa, Brucella spp.
HDPEAPH

SEQ ID NO: 1217 - protein, 8 aa, Brucella spp.
DATTGQNA

SEQ ID NO: 1218 - protein, 6 aa, Brucella spp.
DGTARG

SEQ ID NO: 1219 - protein, 11 aa, Brucella spp.
READAAGLGTL

SEQ ID NO: 1220 - protein, 5 aa, Brucella spp.
RQARQ

SEQ ID NO: 1221 - protein, 9 aa, Brucella spp.
KARRENPDA

SEQ ID NO: 1222 - protein, 7 aa, Brucella spp.
AQTEADN

SEQ ID NO: 1223 - protein, 8 aa, Brucella spp.
EEKLKSNS

SEQ ID NO: 1224 - protein, 8 aa, Brucella spp.
RGNSRSVP

SEQ ID NO: 1225 - protein, 9 aa, Brucella spp.
SYGPDLPSN

SEQ ID NO: 1226 - protein, 6 aa, Brucella spp.
SIEADE

SEQ ID NO: 1227 - protein, 6 aa, Brucella spp.
FPTETE

SEQ ID NO: 1228 - protein, 11 aa, Brucella spp.
SPREGTPAARM

SEQ ID NO: 1229 - protein, 11 aa, Brucella spp.
RLRAEGDRAYE

SEQ ID NO: 1230 - protein, 6 aa, Brucella spp.
GVARTE

SEQ ID NO: 1231 - protein, 7 aa, Brucella spp.
DQGNAGE

SEQ ID NO: 1232 - protein, 5 aa, Brucella spp.
GHDGE

SEQ ID NO: 1233 - protein, 9 aa, Brucella spp.
GRADSITSA

SEQ ID NO: 1234 - protein, 8 aa, Brucella spp.
ASDSETAF

SEQ ID NO: 1235 - protein, 7 aa, Brucella spp.
PRTPGTD

SEQ ID NO: 1236 - protein, 11 aa, Brucella spp.
GTQAQACGNGT

SEQ ID NO: 1237 - protein, 5 aa, Brucella spp.
AETGR

SEQ ID NO: 1238 - protein, 6 aa, Brucella spp.
TEHDDG

SEQ ID NO: 1239 - protein, 4 aa, Brucella spp.
ADTR

SEQ ID NO: 1240 - protein, 6 aa, Brucella spp.
DPADAP

SEQ ID NO: 1241 - protein, 5 aa, Brucella spp.
ASMGN

SEQ ID NO: 1242 - protein, 5 aa, Brucella spp.
TSSDT

SEQ ID NO: 1243 - protein, 11 aa, Brucella spp.
SAARTGRTGRK

SEQ ID NO: 1244 - protein, 4 aa, Brucella spp.
NVPG

SEQ ID NO: 1245 - protein, 26 aa, Brucella spp.
FDPATGEWSRDTQGLQGSGNADRGAA

SEQ ID NO: 1246 - protein, 10 aa, Brucella spp.
HAPRTNANIG

SEQ ID NO: 1247 - protein, 4 aa, Brucella spp.
QAEE

SEQ ID NO: 1248 - protein, 22 aa, Brucella spp.
HAGGRGKGKFKELPADAKGGVR

SEQ ID NO: 1249 - protein, 10 aa, Brucella spp.
TKQTGEAGKQ

SEQ ID NO: 1250 - protein, 4 aa, Brucella spp.
ADIE

SEQ ID NO: 1251 - protein, 4 aa, Brucella spp.
EGGM

SEQ ID NO: 1252 - protein, 7 aa, Brucella spp.
AEETPEK

SEQ ID NO: 1253 - protein, 14 aa, Brucella spp.
PAKGVTDEDANKLA

SEQ ID NO: 1254 - protein, 8 aa, Brucella spp.
EGGAREDG

SEQ ID NO: 1255 - protein, 11 aa, Brucella spp.
TEEDPKEIEAS

SEQ ID NO: 1256 - protein, 4 aa, Brucella spp.
AEPA

SEQ ID NO: 1257 - protein, 10 aa, Brucella spp.
GGGASKEKVT

SEQ ID NO: 1258 - protein, 4 aa, Brucella spp.
TNVE

SEQ ID NO: 1259 - protein, 16 aa, Brucella spp.
DLDDAAQKIVAAVKGN

SEQ ID NO: 1260 - protein, 9 aa, Brucella spp.
TGKTGTFHT

SEQ ID NO: 1261 - protein, 17 aa, Brucella spp.
HPKKGGETWEGSKGEKL

SEQ ID NO: 1262 - protein, 10 aa, Brucella spp.
EGKERTGADA

SEQ ID NO: 1263 - protein, 6 aa, Brucella spp.
PAGAAD

SEQ ID NO: 1264 - protein, 7 aa, Brucella spp.
RLERSKS

SEQ ID NO: 1265 - protein, 5 aa, Brucella spp.
RSGTL

SEQ ID NO: 1266 - protein, 11 aa, Brucella spp.
TSNEGLGQTTA

SEQ ID NO: 1267 - protein, 11 aa, Brucella spp.
VGIGGDPVKGT

SEQ ID NO: 1268 - protein, 4 aa, Brucella spp.
DETK

SEQ ID NO: 1269 - protein, 9 aa, Brucella spp.
GGSAEEDAA

SEQ ID NO: 1270 - protein, 10 aa, Brucella spp.
DEAKRGRKKP

SEQ ID NO: 1271 - protein, 7 aa, Brucella spp.
ALAGRTM

SEQ ID NO: 1272 - protein, 12 aa, Brucella spp.
ISGGKGGAEDKI

SEQ ID NO: 1273 - protein, 19 aa, Brucella spp.
RVSPSPAQLGKTLVEVLKG

SEQ ID NO: 1274 - protein, 11 aa, Brucella spp.
YEDDPNSVDPQ

SEQ ID NO: 1275 - protein, 17 aa, Brucella spp.
GDNADDVKKNAEGPSWT

SEQ ID NO: 1276 - protein, 23 aa, Brucella spp.
TDKLKGKAAKGEAKGAAGTPLTA

SEQ ID NO: 1277 - protein, 9 aa, Brucella spp.
EITQAARDS

SEQ ID NO: 1278 - protein, 15 aa, Brucella spp.
AEKPNDYNELEPENY

SEQ ID NO: 1279 - protein, 5 aa, Brucella spp.
FTPAD

SEQ ID NO: 1280 - protein, 5 aa, Brucella spp.
DPAEK

SEQ ID NO: 1281 - protein, 7 aa, Brucella spp.
IEGPDKK

SEQ ID NO: 1282 - protein, 9 aa, Brucella spp.
AFTPEGKKA

SEQ ID NO: 1283 - protein, 11 aa, Brucella spp.
KGTKRFGLDGG

SEQ ID NO: 1284 - protein, 5 aa, Brucella spp.
RGGQM

SEQ ID NO: 1285 - protein, 15 aa, Brucella spp.
GGSYTPDDVEGSGDV

SEQ ID NO: 1286 - protein, 9 aa, Brucella spp.
ASSDREFDG

SEQ ID NO: 1287 - protein, 4 aa, Brucella spp.
ANPS

SEQ ID NO: 1288 - protein, 5 aa, Brucella spp.
ARAKQ

SEQ ID NO: 1289 - protein, 4 aa, Brucella spp.
FAGQ

SEQ ID NO: 1290 - protein, 14 aa, Brucella spp.
TNPAFSRSSPYPSD

SEQ ID NO: 1291 - protein, 6 aa, Brucella spp.
GDDPEA

SEQ ID NO: 1292 - protein, 10 aa, Brucella spp.
HNEGDEPSFT

SEQ ID NO: 1293 - protein, 15 aa, Brucella spp.
GEFEAGQSYKPNKAD

SEQ ID NO: 1294 - protein, 18 aa, Brucella spp.
RTADNADEQRRGKTAVPV

SEQ ID NO: 1295 - protein, 5 aa, Brucella spp.
METGE

SEQ ID NO: 1296 - protein, 10 aa, Brucella spp.
GQDVERGTFS

SEQ ID NO: 1297 - protein, 6 aa, Brucella spp.
QENQNR

SEQ ID NO: 1298 - protein, 4 aa, Brucella spp.
KGQA

SEQ ID NO: 1299 - protein, 4 aa, Brucella spp.
LSDP

SEQ ID NO: 1300 - protein, 11 aa, Brucella spp.
EGQGPEHSSAR

SEQ ID NO: 1301 - protein, 4 aa, Brucella spp.
VTTP

SEQ ID NO: 1302 - protein, 6 aa, Brucella spp.
LSGESS

SEQ ID NO: 1303 - protein, 10 aa, Brucella spp.
QYNKDEGIKL

SEQ ID NO: 1304 - protein, 7 aa, Brucella spp.
EREKRGI

SEQ ID NO: 1305 - protein, 5 aa, Brucella spp.
EPKNM

SEQ ID NO: 1306 - protein, 13 aa, Brucella spp.
AGRPAAASPATGL

SEQ ID NO: 1307 - protein, 7 aa, Brucella spp.
ESVTEAT

SEQ ID NO: 1308 - protein, 4 aa, Brucella spp.
GEAI

SEQ ID NO: 1309 - protein, 6 aa, Brucella spp.
VPAPAA

SEQ ID NO: 1310 - protein, 9 aa, Brucella spp.
TAKEGDTVE

SEQ ID NO: 1311 - protein, 47 aa, Brucella spp.
ISSDGAAVAAAPAQKKEEAKPAAAAPAAAPVASASSGPAMQPAPAAA

SEQ ID NO: 1312 - protein, 18 aa, Brucella spp.
ESGLSADQVEGSGKRGQV

SEQ ID NO: 1313 - protein, 26 aa, Brucella spp.
GVSAAPAAPVAARPASSADDASREER

SEQ ID NO: 1314 - protein, 7 aa, Brucella spp.
KDAQNTA

SEQ ID NO: 1315 - protein, 5 aa, Brucella spp.
EIDGT

SEQ ID NO: 1316 - protein, 8 aa, Brucella spp.
RAARDGSL

SEQ ID NO: 1317 - protein, 5 aa, Brucella spp.
APQSG

SEQ ID NO: 1318 - protein, 12 aa, Brucella spp.
SLEDPERLVLDL

SEQ ID NO: 1319 - protein, 4 aa, Brucella spp.
PGGY

SEQ ID NO: 1320 - protein, 6 aa, Brucella spp.
RKTFGG

SEQ ID NO: 1321 - protein, 8 aa, Brucella spp.
KDTTVKAN

SEQ ID NO: 1322 - protein, 5 aa, Brucella spp.
ITPYI

SEQ ID NO: 1323 - protein, 18 aa, Brucella spp.
VGKGKVSVTSEDGKVEEI

SEQ ID NO: 1324 - protein, 6 aa, Brucella spp.
DVAGIP

SEQ ID NO: 1325 - protein, 5 aa, Brucella spp.
PMDGE

SEQ ID NO: 1326 - protein, 12 aa, Brucella spp.
VTGVEKVGKGAK

SEQ ID NO: 1327 - protein, 11 aa, Brucella spp.
PVKGGDAETLE

SEQ ID NO: 1328 - protein, 8 aa, Brucella spp.
GRRPYTDG

SEQ ID NO: 1329 - protein, 6 aa, Brucella spp.
VDERGR

SEQ ID NO: 1330 - protein, 6 aa, Brucella spp.
AEDEGI

SEQ ID NO: 1331 - protein, 11 aa, Brucella spp.
ASVGKTEEELK

SEQ ID NO: 1332 - protein, 5 aa, Brucella spp.
TANGR

SEQ ID NO: 1333 - protein, 5 aa, Brucella spp.
KATDR

SEQ ID NO: 1334 - protein, 7 aa, Brucella spp.
GSSEDLA

SEQ ID NO: 1335 - protein, 4 aa, Brucella spp.
ETVR

SEQ ID NO: 1336 - protein, 7 aa, Brucella spp.
GEPPSLK

SEQ ID NO: 1337 - protein, 13 aa, Brucella spp.
RRNDGAGARTLGR

SEQ ID NO: 1338 - protein, 28 aa, Brucella spp.
AAGASAMRAPRQPKSLPKPLTADDARRV

SEQ ID NO: 1339 - protein, 6 aa, Brucella spp.
DGQMAE

SEQ ID NO: 1340 - protein, 23 aa, Brucella spp.
SGDALSDPSARSMTITGKGSKTR

SEQ ID NO: 1341 - protein, 6 aa, Brucella spp.
AKGGPL

SEQ ID NO: 1342 - protein, 9 aa, Brucella spp.
GLPDSATPH

SEQ ID NO: 1343 - protein, 4 aa, Brucella spp.
GGDL

SEQ ID NO: 1344 - protein, 6 aa, Brucella spp.
LSTTQV

SEQ ID NO: 1345 - protein, 7 aa, Brucella spp.
AHGTRGE

SEQ ID NO: 1346 - protein, 5 aa, Brucella spp.
EQGKA

SEQ ID NO: 1347 - protein, 10 aa, Brucella spp.
NDRNAAEALN

SEQ ID NO: 1348 - protein, 8 aa, Brucella spp.
QLPDEELD

SEQ ID NO: 1349 - protein, 9 aa, Brucella spp.
VDGDGKSYG

SEQ ID NO: 1350 - protein, 7 aa, Brucella spp.
SEKGKRP

SEQ ID NO: 1351 - protein, 16 aa, Brucella spp.
EHDNPPHESGKKPKKP

SEQ ID NO: 1352 - protein, 6 aa, Brucella spp.
KALAEG

SEQ ID NO: 1353 - protein, 10 aa, Brucella spp.
DDTPSGGGAG

SEQ ID NO: 1354 - protein, 6 aa, Brucella spp.
SVDDGR

SEQ ID NO: 1355 - protein, 8 aa, Brucella spp.
RGKPLTQE

SEQ ID NO: 1356 - protein, 4 aa, Brucella spp.
ADGA

SEQ ID NO: 1357 - protein, 5 aa, Brucella spp.
SGGET

SEQ ID NO: 1358 - protein, 11 aa, Brucella spp.
NRESGETESFE

SEQ ID NO: 1359 - protein, 7 aa, Brucella spp.
TRPQEWE

SEQ ID NO: 1360 - protein, 6 aa, Brucella spp.
SGNHGA

SEQ ID NO: 1361 - protein, 8 aa, Brucella spp.
RITRERRP

SEQ ID NO: 1362 - protein, 4 aa, Brucella spp.
PNRQ

SEQ ID NO: 1363 - protein, 4 aa, Brucella spp.
SPRC

SEQ ID NO: 1364 - protein, 10 aa, Brucella spp.
PHEGSTSTAY

SEQ ID NO: 1365 - protein, 8 aa, Brucella spp.
ADPLGREN

SEQ ID NO: 1366 - protein, 6 aa, Brucella spp.
GEAQTE

SEQ ID NO: 1367 - protein, 6 aa, Brucella spp.
LTTPGK

SEQ ID NO: 1368 - protein, 6 aa, Brucella spp.
VQAAGR

SEQ ID NO: 1369 - protein, 20 aa, Brucella spp.
ARGEAPTDSRNGHKEDIDHV

SEQ ID NO: 1370 - protein, 5 aa, Brucella spp.
VPFEG

SEQ ID NO: 1371 - protein, 6 aa, Brucella spp.
FSNGDQ

SEQ ID NO: 1372 - protein, 10 aa, Brucella spp.
AAARAAAEAG

SEQ ID NO: 1373 - protein, 8 aa, Brucella spp.
QGTPGQLG

SEQ ID NO: 1374 - protein, 4 aa, Brucella spp.
VARR

SEQ ID NO: 1375 - protein, 19 aa, Brucella spp.
QAAKIEEKRKLPDFQPGDT

SEQ ID NO: 1376 - protein, 9 aa, Brucella spp.
TEGTRTRVQ

SEQ ID NO: 1377 - protein, 7 aa, Brucella spp.
SGAGLNE

SEQ ID NO: 1378 - protein, 4 aa, Brucella spp.
YGEG

SEQ ID NO: 1379 - protein, 36 aa, Brucella spp.
GKAARIAEKKDNRTKAERAADKLAAAKAEAAKTAAE

SEQ ID NO: 1380 - protein, 6 aa, Brucella spp.
QKPQQG

SEQ ID NO: 1381 - protein, 4 aa, Brucella spp.
SPQA

SEQ ID NO: 1382 - protein, 7 aa, Brucella spp.
PVRHPEK

SEQ ID NO: 1383 - protein, 18 aa, Brucella spp.
VPTSPDRINGIQNEESRI

SEQ ID NO: 1384 - protein, 7 aa, Brucella spp.
SERDKRQ

SEQ ID NO: 1385 - protein, 8 aa, Brucella spp.
SHTSTHGA

SEQ ID NO: 1386 - protein, 5 aa, Brucella spp.
IGTSE

SEQ ID NO: 1387 - protein, 6 aa, Brucella spp.
LPAGVT

SEQ ID NO: 1388 - protein, 7 aa, Brucella spp.
GTAGGTG

SEQ ID NO: 1389 - protein, 5 aa, Brucella spp.
EGGAR

SEQ ID NO: 1390 - protein, 6 aa, Brucella spp.
APDETT

SEQ ID NO: 1391 - protein, 12 aa, Brucella spp.
GRPRAPQGETLE

SEQ ID NO: 1392 - protein, 6 aa, Brucella spp.
SDEGAH

SEQ ID NO: 1393 - protein, 4 aa, Brucella spp.
SLPP

SEQ ID NO: 1394 - protein, 7 aa, Brucella spp.
GSSPEDV

SEQ ID NO: 1395 - protein, 16 aa, Brucella spp.
VPNPDDIADETKRASK

SEQ ID NO: 1396 - protein, 7 aa, Brucella spp.
KPGTKIT

SEQ ID NO: 1397 - protein, 4 aa, Brucella spp.
NGRI

SEQ ID NO: 1398 - protein, 10 aa, Brucella spp.
VVEGKKVAPT

SEQ ID NO: 1399 - protein, 8 aa, Brucella spp.
KEQAEAEG

SEQ ID NO: 1400 - protein, 26 aa, Brucella spp.
DRLKPGERCASTSNRNFEGRQGFKGR

SEQ ID NO: 1401 - protein, 5 aa, Brucella spp.
AASKY

SEQ ID NO: 1402 - protein, 6 aa, Brucella spp.
GGAGLR

SEQ ID NO: 1403 - protein, 7 aa, Brucella spp.
AAQGGIA

SEQ ID NO: 1404 - protein, 6 aa, Brucella spp.
KNMGPD

SEQ ID NO: 1405 - protein, 5 aa, Brucella spp.
SDWLG

SEQ ID NO: 1406 - protein, 7 aa, Brucella spp.
SRTEEGK

SEQ ID NO: 1407 - protein, 8 aa, Brucella spp.
GDGPPVQR

SEQ ID NO: 1408 - protein, 6 aa, Brucella spp.
AADRTG

SEQ ID NO: 1409 - protein, 4 aa, Brucella spp.
SLKN

SEQ ID NO: 1410 - protein, 5 aa, Brucella spp.
GGYGR

SEQ ID NO: 1411 - protein, 11 aa, Brucella spp.
AHTCTGDGGGM

SEQ ID NO: 1412 - protein, 8 aa, Brucella spp.
EGARGEGG

SEQ ID NO: 1413 - protein, 11 aa, Brucella spp.
APSAKDLASRD

SEQ ID NO: 1414 - protein, 8 aa, Brucella spp.
GRGVGKNK

SEQ ID NO: 1415 - protein, 5 aa, Brucella spp.
PGISE

SEQ ID NO: 1416 - protein, 4 aa, Brucella spp.
KEPI

SEQ ID NO: 1417 - protein, 11 aa, Brucella spp.
NPTKEDPDRVQ

SEQ ID NO: 1418 - protein, 7 aa, Brucella spp.
ANRLGSN

SEQ ID NO: 1419 - protein, 5 aa, Brucella spp.
SKIPD

SEQ ID NO: 1420 - protein, 8 aa, Brucella spp.
NGSTPTAV

SEQ ID NO: 1421 - protein, 4 aa, Brucella spp.
RTMQ

SEQ ID NO: 1422 - protein, 9 aa, Brucella spp.
EESLKQGVE

SEQ ID NO: 1423 - protein, 23 aa, Brucella spp.
EARQESRGAHAREDFPDRNDAEW

SEQ ID NO: 1424 - protein, 8 aa, Brucella spp.
RLSPDGKV

SEQ ID NO: 1425 - protein, 8 aa, Brucella spp.
TTEEEGGI

SEQ ID NO: 1426 - protein, 7 aa, Brucella spp.
YGRNGKP

SEQ ID NO: 1427 - protein, 5 aa, Brucella spp.
KGAKL

SEQ ID NO: 1428 - protein, 7 aa, Brucella spp.
AGTRSEV

SEQ ID NO: 1429 - protein, 14 aa, Brucella spp.
AAGGRDNGKPGLRP

SEQ ID NO: 1430 - protein, 13 aa, Brucella spp.
DGHNIEVVCHLPE

SEQ ID NO: 1431 - protein, 11 aa, Brucella spp.
KARGEKGEQWD

SEQ ID NO: 1432 - protein, 6 aa, Brucella spp.
YQARNN

SEQ ID NO: 1433 - protein, 10 aa, Brucella spp.
HPDSTTDDPR

SEQ ID NO: 1434 - protein, 5 aa, Brucella spp.
MPKPV

SEQ ID NO: 1435 - protein, 6 aa, Brucella spp.
KANPRL

SEQ ID NO: 1436 - protein, 4 aa, Brucella spp.
PVTE

SEQ ID NO: 1437 - protein, 9 aa, Brucella spp.
GEDGKPNGS

SEQ ID NO: 1438 - protein, 15 aa, Brucella spp.
ADKAAAEKIAASDPY

SEQ ID NO: 1439 - protein, 16 aa, Brucella spp.
TAGDRIQDRPLSEVGG

SEQ ID NO: 1440 - protein, 4 aa, Brucella spp.
LKDG

SEQ ID NO: 1441 - protein, 8 aa, Brucella spp.
TKDMPTAL

SEQ ID NO: 1442 - protein, 6 aa, Brucella spp.
REDPRD

SEQ ID NO: 1443 - protein, 10 aa, Brucella spp.
GATVGSSSLR

SEQ ID NO: 1444 - protein, 6 aa, Brucella spp.
DAGEVD

SEQ ID NO: 1445 - protein, 10 aa, Brucella spp.
FPPAPGQGAI

SEQ ID NO: 1446 - protein, 4 aa, Brucella spp.
IGDE

SEQ ID NO: 1447 - protein, 5 aa, Brucella spp.
SCRTP

SEQ ID NO: 1448 - protein, 10 aa, Brucella spp.
PDGRQAHEVT

SEQ ID NO: 1449 - protein, 10 aa, Brucella spp.
AALGTDAANR

SEQ ID NO: 1450 - protein, 8 aa, Brucella spp.
AAAQTAAK

SEQ ID NO: 1451 - protein, 11 aa, Brucella spp.
EGTAKAAQEAG

SEQ ID NO: 1452 - protein, 6 aa, Brucella spp.
EGGGDA

SEQ ID NO: 1453 - protein, 6 aa, Brucella spp.
TPPFDE

SEQ ID NO: 1454 - protein, 15 aa, Brucella spp.
DHPDEKGLFRLFSKL

SEQ ID NO: 1455 - protein, 6 aa, Brucella spp.
PARNPV

SEQ ID NO: 1456 - protein, 86 aa, Brucella spp.
DPSEVKRVDEPAAAKATPAAEPVGGFSGKAEAKPAAQAAPASSTGPDKAPFTAGVKPEAESPRETANAAPSAATPPADGRSGGGAS

SEQ ID NO: 1457 - protein, 10 aa, Brucella spp.
IPSPGARVTA

SEQ ID NO: 1458 - protein, 17 aa, Brucella spp.
RSNPAPAPLDDAGKAEF

SEQ ID NO: 1459 - protein, 5 aa, Brucella spp.
VEAAE

SEQ ID NO: 1460 - protein, 4 aa, Brucella spp.
AGTL

SEQ ID NO: 1461 - protein, 16 aa, Brucella spp.
ALPTTSENGTAAGDIA

SEQ ID NO: 1462 - protein, 26 aa, Brucella spp.
KLSETRSQADEASAGVSGNSGTISSL

SEQ ID NO: 1463 - protein, 5 aa, Brucella spp.
LTSLQ

SEQ ID NO: 1464 - protein, 12 aa, Brucella spp.
EKMSETARQPDA

SEQ ID NO: 1465 - protein, 10 aa, Brucella spp.
TAIDRGGSFK

SEQ ID NO: 1466 - protein, 8 aa, Brucella spp.
APQDASVE

SEQ ID NO: 1467 - protein, 8 aa, Brucella spp.
ADKGVPTI

SEQ ID NO: 1468 - protein, 7 aa, Brucella spp.
NKLPADA

SEQ ID NO: 1469 - protein, 15 aa, Brucella spp.
AGNVSGTGVGPTTAR

SEQ ID NO: 1470 - protein, 4 aa, Brucella spp.
AGDL

SEQ ID NO: 1471 - protein, 11 aa, Brucella spp.
PADAKAVSEEF

SEQ ID NO: 1472 - protein, 7 aa, Brucella spp.
KARRDAD

SEQ ID NO: 1473 - protein, 24 aa, Brucella spp.
LKPKAPVTGASDNTTGEAPASSGQ

SEQ ID NO: 1474 - protein, 7 aa, Brucella spp.
QRAEPGA

SEQ ID NO: 1475 - protein, 7 aa, Brucella spp.
GHTGAAA

SEQ ID NO: 1476 - protein, 9 aa, Brucella spp.
AAIAQTGKA

SEQ ID NO: 1477 - protein, 8 aa, Brucella spp.
LPLKPGSA

SEQ ID NO: 1478 - protein, 7 aa, Brucella spp.
TNDTPGA

SEQ ID NO: 1479 - protein, 8 aa, Brucella spp.
SGSGTLGE

SEQ ID NO: 1480 - protein, 8 aa, Brucella spp.
LTGGASPR

SEQ ID NO: 1481 - protein, 7 aa, Brucella spp.
RSRKPVS

SEQ ID NO: 1482 - protein, 7 aa, Brucella spp.
SDPDGRI

SEQ ID NO: 1483 - protein, 28 aa, Brucella spp.
PHESQQKPLKPGSAKASLAEALKKAEDG

SEQ ID NO: 1484 - protein, 5 aa, Brucella spp.
ATYAA

SEQ ID NO: 1485 - protein, 4 aa, Brucella spp.
QPGT

SEQ ID NO: 1486 - protein, 7 aa, Brucella spp.
IADPPSF

SEQ ID NO: 1487 - protein, 6 aa, Brucella spp.
RPFAPQ

SEQ ID NO: 1488 - protein, 8 aa, Brucella spp.
RRTEQQVG

SEQ ID NO: 1489 - protein, 11 aa, Brucella spp.
LGAKERKRNVD

SEQ ID NO: 1490 - protein, 10 aa, Brucella spp.
TTGATVKAAT

SEQ ID NO: 1491 - protein, 5 aa, Brucella spp.
GGAKS

SEQ ID NO: 1492 - protein, 7 aa, Brucella spp.
RKGAEFN

SEQ ID NO: 1493 - protein, 8 aa, Brucella spp.
ASATPELR

SEQ ID NO: 1494 - protein, 9 aa, Brucella spp.
MQERSGRNT

SEQ ID NO: 1495 - protein, 15 aa, Brucella spp.
DEGKLDSLLKTGKLI

SEQ ID NO: 1496 - protein, 6 aa, Brucella spp.
DFERQS

SEQ ID NO: 1497 - protein, 8 aa, Brucella spp.
STSRGREK

SEQ ID NO: 1498 - protein, 8 aa, Brucella spp.
QVRENADY

SEQ ID NO: 1499 - protein, 5 aa, Brucella spp.
FAEEA

SEQ ID NO: 1500 - protein, 16 aa, Brucella spp.
ETQARGIYGEASRDDV

SEQ ID NO: 1501 - protein, 6 aa, Brucella spp.
EVEAGN

SEQ ID NO: 1502 - protein, 6 aa, Brucella spp.
SGKTNE

SEQ ID NO: 1503 - protein, 6 aa, Brucella spp.
ASSPFY

SEQ ID NO: 1504 - protein, 7 aa, Brucella spp.
SGEQVTS

SEQ ID NO: 1505 - protein, 8 aa, Brucella spp.
TDNAHGAA

SEQ ID NO: 1506 - protein, 7 aa, Brucella spp.
GIGPDNR

SEQ ID NO: 1507 - protein, 12 aa, Brucella spp.
TLGRGGSDTSAV

SEQ ID NO: 1508 - protein, 14 aa, Brucella spp.
YTTDPRIEPKARRL

SEQ ID NO: 1509 - protein, 17 aa, Brucella spp.
FTDPDAPGMGDPINPPG

SEQ ID NO: 1510 - protein, 5 aa, Brucella spp.
DEAQI

SEQ ID NO: 1511 - protein, 6 aa, Brucella spp.
ADRPGV

SEQ ID NO: 1512 - protein, 10 aa, Brucella spp.
VSEDGSKTDM

SEQ ID NO: 1513 - protein, 4 aa, Brucella spp.
TGDI

SEQ ID NO: 1514 - protein, 6 aa, Brucella spp.
AKSEIS

SEQ ID NO: 1515 - protein, 6 aa, Brucella spp.
QSETGL

SEQ ID NO: 1516 - protein, 10 aa, Brucella spp.
MANNPDSDTY

SEQ ID NO: 1517 - protein, 4 aa, Brucella spp.
EYSE

SEQ ID NO: 1518 - protein, 5 aa, Brucella spp.
ARMEA

SEQ ID NO: 1519 - protein, 9 aa, Brucella spp.
RDDASTDAE

SEQ ID NO: 1520 - protein, 7 aa, Brucella spp.
DAADDKN

SEQ ID NO: 1521 - protein, 6 aa, Brucella spp.
AGTGGL

SEQ ID NO: 1522 - protein, 9 aa, Brucella spp.
ASEGDAGGY

SEQ ID NO: 1523 - protein, 13 aa, Brucella spp.
VPETEAGGRIHTS

SEQ ID NO: 1524 - protein, 15 aa, Brucella spp.
ASGAGGQHVNTTDSA

SEQ ID NO: 1525 - protein, 9 aa, Brucella spp.
EKSQHQNRA

SEQ ID NO: 1526 - protein, 25 aa, Brucella spp.
RQKAESERSQARRSQVGSGDRSERI

SEQ ID NO: 1527 - protein, 10 aa, Brucella spp.
LSSGNQQFTP

SEQ ID NO: 1528 - protein, 5 aa, Brucella spp.
DEGLA

SEQ ID NO: 1529 - protein, 7 aa, Brucella spp.
RAGGRVG

SEQ ID NO: 1530 - protein, 9 aa, Brucella spp.
PKVSGGNDQ

SEQ ID NO: 1531 - protein, 9 aa, Brucella spp.
LASKAGDSF

SEQ ID NO: 1532 - protein, 8 aa, Brucella spp.
KSAKTSEI

SEQ ID NO: 1533 - protein, 6 aa, Brucella spp.
GVTPTA

SEQ ID NO: 1534 - protein, 16 aa, Brucella spp.
RKGRTADSASAESNYD

SEQ ID NO: 1535 - protein, 13 aa, Brucella spp.
RDLTEDARAGKLD

SEQ ID NO: 1536 - protein, 7 aa, Brucella spp.
RRTKNNP

SEQ ID NO: 1537 - protein, 9 aa, Brucella spp.
EPGVGKTAI

SEQ ID NO: 1538 - protein, 7 aa, Brucella spp.
DVPESLK

SEQ ID NO: 1539 - protein, 6 aa, Brucella spp.
YRGEFE

SEQ ID NO: 1540 - protein, 10 aa, Brucella spp.
AGKTDGAMDA

SEQ ID NO: 1541 - protein, 5 aa, Brucella spp.
PTVED

SEQ ID NO: 1542 - protein, 5 aa, Brucella spp.
KYEQH

SEQ ID NO: 1543 - protein, 9 aa, Brucella spp.
DSKPEELDE

SEQ ID NO: 1544 - protein, 12 aa, Brucella spp.
VETDAASKDRLQ

SEQ ID NO: 1545 - protein, 10 aa, Brucella spp.
SDLEEESAEL

SEQ ID NO: 1546 - protein, 6 aa, Brucella spp.
QAEKQK

SEQ ID NO: 1547 - protein, 6 aa, Brucella spp.
QLEEAR

SEQ ID NO: 1548 - protein, 9 aa, Brucella spp.
RNGEFQKAG

SEQ ID NO: 1549 - protein, 12 aa, Brucella spp.
ADAESQENKGSL

SEQ ID NO: 1550 - protein, 5 aa, Brucella spp.
TVTPD

SEQ ID NO: 1551 - protein, 7 aa, Brucella spp.
VGQGEAV

SEQ ID NO: 1552 - protein, 14 aa, Brucella spp.
RRARAGLQDPNRPI

SEQ ID NO: 1553 - protein, 9 aa, Brucella spp.
TGVGKTELT

SEQ ID NO: 1554 - protein, 6 aa, Brucella spp.
APPGYV

SEQ ID NO: 1555 - protein, 10 aa, Brucella spp.
GRLTDGQGHT

SEQ ID NO: 1556 - protein, 8 aa, Brucella spp.
ENDDVETV

SEQ ID NO: 1557 - protein, 10 aa, Brucella spp.
GYDPAYGARP

SEQ ID NO: 1558 - protein, 5 aa, Brucella spp.
VQDPL

SEQ ID NO: 1559 - protein, 6 aa, Brucella spp.
TAGSDR

SEQ ID NO: 1560 - protein, 12 aa, Brucella spp.
SAAEPEREDEKA

SEQ ID NO: 1561 - protein, 10 aa, Brucella spp.
ADEAAGTVAS

SEQ ID NO: 1562 - protein, 5 aa, Brucella spp.
DPGDE

SEQ ID NO: 1563 - protein, 21 aa, Brucella spp.
ANSYDRNQYAARGRAVAPDDN

SEQ ID NO: 1564 - protein, 13 aa, Brucella spp.
DGPVDGGAPYDGF

SEQ ID NO: 1565 - protein, 67 aa, Brucella spp.
GDVPEDPNYYPAPPAAPDYQGNRDGQVQRSELPPPGADYPDNTGTASIAPDYRQPSARPQGVPNPND

SEQ ID NO: 1566 - protein, 10 aa, Brucella spp.
PKGQGAKAKI

SEQ ID NO: 1567 - protein, 25 aa, Brucella spp.
AGASPGVIDGRSGSNVDKAAAAYRE

SEQ ID NO: 1568 - protein, 8 aa, Brucella spp.
NPTDEAAV

SEQ ID NO: 1569 - protein, 9 aa, Brucella spp.
LEATGGPAF

SEQ ID NO: 1570 - protein, 4 aa, Brucella spp.
DVGR

SEQ ID NO: 1571 - protein, 4 aa, Brucella spp.
PEDY

SEQ ID NO: 1572 - protein, 6 aa, Brucella spp.
FNQPGS

SEQ ID NO: 1573 - protein, 7 aa, Brucella spp.
NLGKPVR

SEQ ID NO: 1574 - protein, 12 aa, Brucella spp.
KGRKQVRGYDEN

SEQ ID NO: 1575 - protein, 14 aa, Brucella spp.
STIGSSDNPSPSGI

SEQ ID NO: 1576 - protein, 5 aa, Brucella spp.
NYTYN

SEQ ID NO: 1577 - protein, 7 aa, Brucella spp.
KQGNNDK

SEQ ID NO: 1578 - protein, 9 aa, Brucella spp.
IPPGPNGPV

SEQ ID NO: 1579 - protein, 15 aa, Brucella spp.
PTYGIHGTPAPSRIG

SEQ ID NO: 1580 - protein, 6 aa, Brucella spp.
TGNANH

SEQ ID NO: 1581 - protein, 8 aa, Brucella spp.
NSSGAELA

SEQ ID NO: 1582 - protein, 6 aa, Brucella spp.
GSIGRS

SEQ ID NO: 1583 - protein, 15 aa, Brucella spp.
KSVRADLEAQRKSIA

SEQ ID NO: 1584 - protein, 10 aa, Brucella spp.
EKIAPTDPNE

SEQ ID NO: 1585 - protein, 6 aa, Brucella spp.
CDGSGA

SEQ ID NO: 1586 - protein, 4 aa, Brucella spp.
DAGR

SEQ ID NO: 1587 - protein, 6 aa, Brucella spp.
NGYGQY

SEQ ID NO: 1588 - protein, 4 aa, Brucella spp.
LGEA

SEQ ID NO: 1589 - protein, 13 aa, Brucella spp.
KEPQPKVASKDKE

SEQ ID NO: 1590 - protein, 6 aa, Brucella spp.
SDGPVY

SEQ ID NO: 1591 - protein, 6 aa, Brucella spp.
ASGKSI

SEQ ID NO: 1592 - protein, 9 aa, Brucella spp.
QQSKESQTF

SEQ ID NO: 1593 - protein, 7 aa, Brucella spp.
GRAEDAL

SEQ ID NO: 1594 - protein, 7 aa, Brucella spp.
GRAEEAQ

SEQ ID NO: 1595 - protein, 6 aa, Brucella spp.
VEAEEK

SEQ ID NO: 1596 - protein, 5 aa, Brucella spp.
SLSEA

SEQ ID NO: 1597 - protein, 7 aa, Brucella spp.
ASEMDGD

SEQ ID NO: 1598 - protein, 5 aa, Brucella spp.
AAEKL

SEQ ID NO: 1599 - protein, 8 aa, Brucella spp.
NARSSRYK

SEQ ID NO: 1600 - protein, 9 aa, Brucella spp.
TKWHPGANV

SEQ ID NO: 1601 - protein, 10 aa, Brucella spp.
FRTKANGRTY

SEQ ID NO: 1602 - protein, 11 aa, Brucella spp.
GRKAKAAAAPL

SEQ ID NO: 1603 - protein, 13 aa, Brucella spp.
ATNEQKNKALNAA

SEQ ID NO: 1604 - protein, 8 aa, Brucella spp.
NAEKNGMA

SEQ ID NO: 1605 - protein, 5 aa, Brucella spp.
LPDPV

SEQ ID NO: 1606 - protein, 8 aa, Brucella spp.
RPNVTADA

SEQ ID NO: 1607 - protein, 10 aa, Brucella spp.
GGSDSAHSSA

SEQ ID NO: 1608 - protein, 5 aa, Brucella spp.
ANLPA

SEQ ID NO: 1609 - protein, 5 aa, Brucella spp.
RGGKS

SEQ ID NO: 1610 - protein, 7 aa, Brucella spp.
GCEIRGS

SEQ ID NO: 1611 - protein, 11 aa, Brucella spp.
AAKPATEEDWS

SEQ ID NO: 1612 - protein, 4 aa, Brucella spp.
EDAQ

SEQ ID NO: 1613 - protein, 10 aa, Brucella spp.
TQFADGGEFG

SEQ ID NO: 1614 - protein, 5 aa, Brucella spp.
ARGPV

SEQ ID NO: 1615 - protein, 6 aa, Brucella spp.
GSVGNR

SEQ ID NO: 1616 - protein, 14 aa, Brucella spp.
HGVPGAPAGRIVPP

SEQ ID NO: 1617 - protein, 6 aa, Brucella spp.
HPEQAA

SEQ ID NO: 1618 - protein, 7 aa, Brucella spp.
KANNPEA

SEQ ID NO: 1619 - protein, 4 aa, Brucella spp.
ATPN

SEQ ID NO: 1620 - protein, 5 aa, Brucella spp.
DAGPA

SEQ ID NO: 1621 - protein, 11 aa, Brucella spp.
RVDGPTNGLGD

SEQ ID NO: 1622 - protein, 11 aa, Brucella spp.
LSEEKTLQSTT

SEQ ID NO: 1623 - protein, 7 aa, Brucella spp.
SAKRGAD

SEQ ID NO: 1624 - protein, 6 aa, Brucella spp.
ASSLAT

SEQ ID NO: 1625 - protein, 12 aa, Brucella spp.
TGRGALSESDVT

SEQ ID NO: 1626 - protein, 4 aa, Brucella spp.
EKAV

SEQ ID NO: 1627 - protein, 11 aa, Brucella spp.
GSGKTTTTGKI

SEQ ID NO: 1628 - protein, 7 aa, Brucella spp.
RLTERQR

SEQ ID NO: 1629 - protein, 9 aa, Brucella spp.
TRRPAAQEQ

SEQ ID NO: 1630 - protein, 4 aa, Brucella spp.
SPVE

SEQ ID NO: 1631 - protein, 5 aa, Brucella spp.
GRTHI

SEQ ID NO: 1632 - protein, 6 aa, Brucella spp.
KAANPH

SEQ ID NO: 1633 - protein, 6 aa, Brucella spp.
LTGQDA

SEQ ID NO: 1634 - protein, 9 aa, Brucella spp.
DGDGRGGAA

SEQ ID NO: 1635 - protein, 11 aa, Brucella spp.
AENIDAEKAAA

SEQ ID NO: 1636 - protein, 4 aa, Brucella spp.
QSGK

SEQ ID NO: 1637 - protein, 8 aa, Brucella spp.
QVAASGLD

SEQ ID NO: 1638 - protein, 8 aa, Brucella spp.
KAERANPD

SEQ ID NO: 1639 - protein, 15 aa, Brucella spp.
RKQRIAKGSGTNAAD

SEQ ID NO: 1640 - protein, 6 aa, Brucella spp.
KGKGGM

SEQ ID NO: 1641 - protein, 13 aa, Brucella spp.
GLGGLGGGLGGMP

SEQ ID NO: 1642 - protein, 7 aa, Brucella spp.
KMDPKQL

SEQ ID NO: 1643 - protein, 47 aa, Brucella spp.
KQAEAAGLTKGGLGGGLGGLPGGGLSGLGGPKLPGLGGGLPGLPKKK

SEQ ID NO: 1644 - protein, 14 aa, Brucella spp.
RGLAPADPAREKRQ

SEQ ID NO: 1645 - protein, 8 aa, Brucella spp.
DANLDPDF

SEQ ID NO: 1646 - protein, 18 aa, Brucella spp.
KVSKASKEGKKGGKSKAF

SEQ ID NO: 1647 - protein, 5 aa, Brucella spp.
PEDLA

SEQ ID NO: 1648 - protein, 5 aa, Brucella spp.
ALESS

SEQ ID NO: 1649 - protein, 4 aa, Brucella spp.
AYRK

SEQ ID NO: 1650 - protein, 10 aa, Brucella spp.
ARHGKPHSRP

SEQ ID NO: 1651 - protein, 10 aa, Brucella spp.
SQLAPAKGVE

SEQ ID NO: 1652 - protein, 10 aa, Brucella spp.
SKQAKADLTA

SEQ ID NO: 1653 - protein, 5 aa, Brucella spp.
GNAAM

SEQ ID NO: 1654 - protein, 8 aa, Brucella spp.
GTGKKRDL

SEQ ID NO: 1655 - protein, 10 aa, Brucella spp.
KDDDDTVTPR

SEQ ID NO: 1656 - protein, 5 aa, Brucella spp.
NSLSS

SEQ ID NO: 1657 - protein, 6 aa, Brucella spp.
GRGEAI

SEQ ID NO: 1658 - protein, 7 aa, Brucella spp.
REDHSGK

SEQ ID NO: 1659 - protein, 5 aa, Brucella spp.
ESLTA

SEQ ID NO: 1660 - protein, 6 aa, Brucella spp.
RYDSAV

SEQ ID NO: 1661 - protein, 8 aa, Brucella spp.
ERSTPHVD

SEQ ID NO: 1662 - protein, 11 aa, Brucella spp.
VRESAETVDAD

SEQ ID NO: 1663 - protein, 5 aa, Brucella spp.
SFPPS

SEQ ID NO: 1664 - protein, 6 aa, Brucella spp.
GLSPEE

SEQ ID NO: 1665 - protein, 8 aa, Brucella spp.
RTDGPDAV

SEQ ID NO: 1666 - protein, 8 aa, Brucella spp.
HAGKDGAP

SEQ ID NO: 1667 - protein, 9 aa, Brucella spp.
PVDLSDDGE

SEQ ID NO: 1668 - protein, 7 aa, Brucella spp.
ADNDGYN

SEQ ID NO: 1669 - protein, 13 aa, Brucella spp.
SNPSSKRRDAAEK

SEQ ID NO: 1670 - protein, 13 aa, Brucella spp.
NAYQPDGDGKPRV

SEQ ID NO: 1671 - protein, 7 aa, Brucella spp.
LPEPRPY

SEQ ID NO: 1672 - protein, 7 aa, Brucella spp.
DRAQDYR

SEQ ID NO: 1673 - protein, 5 aa, Brucella spp.
KGGFY

SEQ ID NO: 1674 - protein, 6 aa, Brucella spp.
PVGGDR

SEQ ID NO: 1675 - protein, 6 aa, Brucella spp.
HDNDDP

SEQ ID NO: 1676 - protein, 15 aa, Brucella spp.
DKGTATFSDTANAIS

SEQ ID NO: 1677 - protein, 10 aa, Brucella spp.
ASGGSAGYDH

SEQ ID NO: 1678 - protein, 9 aa, Brucella spp.
NPVPADGFA

SEQ ID NO: 1679 - protein, 25 aa, Brucella spp.
SWQDYDRSKLSAGGGIYSRSQKTIT

SEQ ID NO: 1680 - protein, 10 aa, Brucella spp.
LSAEASAAIS

SEQ ID NO: 1681 - protein, 9 aa, Brucella spp.
GKTTATPQE

SEQ ID NO: 1682 - protein, 16 aa, Brucella spp.
SSAETDAQVGDRANDA

SEQ ID NO: 1683 - protein, 5 aa, Brucella spp.
TGSEV

SEQ ID NO: 1684 - protein, 6 aa, Brucella spp.
LGVTQR

SEQ ID NO: 1685 - protein, 16 aa, Brucella spp.
GGRGNTDAIDNSAGVN

SEQ ID NO: 1686 - protein, 10 aa, Brucella spp.
SGKLKRPARN

SEQ ID NO: 1687 - protein, 6 aa, Brucella spp.
ENLPSD

SEQ ID NO: 1688 - protein, 12 aa, Brucella spp.
ERQKAGQPLTRP

SEQ ID NO: 1689 - protein, 7 aa, Brucella spp.
KLPDEPY

SEQ ID NO: 1690 - protein, 5 aa, Brucella spp.
AVNRG

SEQ ID NO: 1691 - protein, 11 aa, Brucella spp.
ADTTGKSPADI

SEQ ID NO: 1692 - protein, 7 aa, Brucella spp.
NQVPGDV

SEQ ID NO: 1693 - protein, 7 aa, Brucella spp.
DTTRANL

SEQ ID NO: 1694 - protein, 4 aa, Brucella spp.
ELEP

SEQ ID NO: 1695 - protein, 4 aa, Brucella spp.
LQAD

SEQ ID NO: 1696 - protein, 8 aa, Brucella spp.
KGASASLA

SEQ ID NO: 1697 - protein, 5 aa, Brucella spp.
AARSI

SEQ ID NO: 1698 - protein, 10 aa, Brucella spp.
RASDTITQAA

SEQ ID NO: 1699 - protein, 9 aa, Brucella spp.
AKEKDPAAA

SEQ ID NO: 1700 - protein, 5 aa, Brucella spp.
GARIE

SEQ ID NO: 1701 - protein, 5 aa, Brucella spp.
EGGDL

SEQ ID NO: 1702 - protein, 4 aa, Brucella spp.
DKTG

SEQ ID NO: 1703 - protein, 11 aa, Brucella spp.
STGGTAKSIAA

SEQ ID NO: 1704 - protein, 5 aa, Brucella spp.
NDPEH

SEQ ID NO: 1705 - protein, 8 aa, Brucella spp.
GGDYDTTV

SEQ ID NO: 1706 - protein, 6 aa, Brucella spp.
KHSGSL

SEQ ID NO: 1707 - protein, 10 aa, Brucella spp.
AKAFSRTAAY

SEQ ID NO: 1708 - protein, 8 aa, Brucella spp.
DEETPTYR

SEQ ID NO: 1709 - protein, 6 aa, Brucella spp.
ENPHQT

SEQ ID NO: 1710 - protein, 16 aa, Brucella spp.
EKRPGVATATQLQGKQ

SEQ ID NO: 1711 - protein, 8 aa, Brucella spp.
NNINDTDA

SEQ ID NO: 1712 - protein, 5 aa, Brucella spp.
DPART

SEQ ID NO: 1713 - protein, 6 aa, Brucella spp.
EASTIK

SEQ ID NO: 1714 - protein, 7 aa, Brucella spp.
LDEEAAE

SEQ ID NO: 1715 - protein, 8 aa, Brucella spp.
PDATEGAQ

SEQ ID NO: 1716 - protein, 15 aa, Brucella spp.
GLPDPRAKGIAAKTV

SEQ ID NO: 1717 - protein, 6 aa, Brucella spp.
RDNGVV

SEQ ID NO: 1718 - protein, 9 aa, Brucella spp.
KRAPTEAEL

SEQ ID NO: 1719 - protein, 5 aa, Brucella spp.
ATVGI

SEQ ID NO: 1720 - protein, 5 aa, Brucella spp.
QMSRV

SEQ ID NO: 1721 - protein, 18 aa, Brucella spp.
AARKAEDAAEAAGLAAPL

SEQ ID NO: 1722 - protein, 10 aa, Brucella spp.
IQPGGSMRDD

SEQ ID NO: 1723 - protein, 4 aa, Brucella spp.
TGGL

SEQ ID NO: 1724 - protein, 7 aa, Brucella spp.
EPPTPEW

SEQ ID NO: 1725 - protein, 11 aa, Brucella spp.
SANSELATANA

SEQ ID NO: 1726 - protein, 8 aa, Brucella spp.
MDDGEERL

SEQ ID NO: 1727 - protein, 10 aa, Brucella spp.
VSPPTARAAR

SEQ ID NO: 1728 - protein, 6 aa, Brucella spp.
GHISRN

SEQ ID NO: 1729 - protein, 11 aa, Brucella spp.
YANGTESPPKA

SEQ ID NO: 1730 - protein, 5 aa, Brucella spp.
GPTMP

SEQ ID NO: 1731 - protein, 16 aa, Brucella spp.
DETAGSPLTHAPYSGY

SEQ ID NO: 1732 - protein, 13 aa, Brucella spp.
GLPPPVTASRDAH

SEQ ID NO: 1733 - protein, 4 aa, Brucella spp.
SGRQ

SEQ ID NO: 1734 - protein, 6 aa, Brucella spp.
RFGPPE

SEQ ID NO: 1735 - protein, 17 aa, Brucella spp.
GRSTAAHSTATINDTSS

SEQ ID NO: 1736 - protein, 7 aa, Brucella spp.
GPTRVQR

SEQ ID NO: 1737 - protein, 14 aa, Brucella spp.
RGDGRPSKANGRDN

SEQ ID NO: 1738 - protein, 5 aa, Brucella spp.
GDRDD

SEQ ID NO: 1739 - protein, 5 aa, Brucella spp.
GPVTS

SEQ ID NO: 1740 - protein, 4 aa, Brucella spp.
SDLP

SEQ ID NO: 1741 - protein, 17 aa, Brucella spp.
NKKPQTNSNSAADLRPG

SEQ ID NO: 1742 - protein, 16 aa, Brucella spp.
KNTSLDGLTDNAHGHP

SEQ ID NO: 1743 - protein, 5 aa, Brucella spp.
NRGSI

SEQ ID NO: 1744 - protein, 7 aa, Brucella spp.
DRPLPEN

SEQ ID NO: 1745 - protein, 11 aa, Brucella spp.
AANSDPRNRKY

SEQ ID NO: 1746 - protein, 5 aa, Brucella spp.
RNKER

SEQ ID NO: 1747 - protein, 4 aa, Brucella spp.
EPEA

SEQ ID NO: 1748 - protein, 9 aa, Brucella spp.
TDAYGTEKA

SEQ ID NO: 1749 - protein, 8 aa, Brucella spp.
GDAKAWAE

SEQ ID NO: 1750 - protein, 6 aa, Brucella spp.
ALPNGS

SEQ ID NO: 1751 - protein, 7 aa, Brucella spp.
APGGKTA

SEQ ID NO: 1752 - protein, 10 aa, Brucella spp.
PCSSTGTVRR

SEQ ID NO: 1753 - protein, 7 aa, Brucella spp.
TKTPQDI

SEQ ID NO: 1754 - protein, 14 aa, Brucella spp.
EGEEMARKAPENPL

SEQ ID NO: 1755 - protein, 4 aa, Brucella spp.
QDCP

SEQ ID NO: 1756 - protein, 17 aa, Brucella spp.
STPADLPPDRLDGNPHM

SEQ ID NO: 1757 - protein, 13 aa, Brucella spp.
RTFETDNSDSREK

SEQ ID NO: 1758 - protein, 4 aa, Brucella spp.
NAAM

SEQ ID NO: 1759 - protein, 10 aa, Brucella spp.
TRKTSKVNWD

SEQ ID NO: 1760 - protein, 6 aa, Brucella spp.
DGRGWR

SEQ ID NO: 1761 - protein, 4 aa, Brucella spp.
KSEG

SEQ ID NO: 1762 - protein, 8 aa, Brucella spp.
AGTAPAGF

SEQ ID NO: 1763 - protein, 6 aa, Brucella spp.
TTRPDT

SEQ ID NO: 1764 - protein, 8 aa, Brucella spp.
KLSEGNAA

SEQ ID NO: 1765 - protein, 5 aa, Brucella spp.
QQGTS

SEQ ID NO: 1766 - protein, 12 aa, Brucella spp.
LETAEKKGFDTG

SEQ ID NO: 1767 - protein, 9 aa, Brucella spp.
KGEDAASFS

SEQ ID NO: 1768 - protein, 7 aa, Brucella spp.
ETAYTDD

SEQ ID NO: 1769 - protein, 6 aa, Brucella spp.
VGRPQA

SEQ ID NO: 1770 - protein, 6 aa, Brucella spp.
NPVPRA

SEQ ID NO: 1771 - protein, 9 aa, Brucella spp.
FDRPGNPLD

SEQ ID NO: 1772 - protein, 13 aa, Brucella spp.
KCGGDARRETDTM

SEQ ID NO: 1773 - protein, 11 aa, Brucella spp.
WENEPTDRKAA

SEQ ID NO: 1774 - protein, 6 aa, Brucella spp.
ANGQWV

SEQ ID NO: 1775 - protein, 5 aa, Brucella spp.
GAPVE

SEQ ID NO: 1776 - protein, 12 aa, Brucella spp.
KMSKSKKNVVDP

SEQ ID NO: 1777 - protein, 5 aa, Brucella spp.
YGADT

SEQ ID NO: 1778 - protein, 7 aa, Brucella spp.
DSPPERD

SEQ ID NO: 1779 - protein, 7 aa, Brucella spp.
AGAEGAH

SEQ ID NO: 1780 - protein, 18 aa, Brucella spp.
APALKDVAPKAGTQGEAL

SEQ ID NO: 1781 - protein, 7 aa, Brucella spp.
KAAHKAV

SEQ ID NO: 1782 - protein, 5 aa, Brucella spp.
AVGDD

SEQ ID NO: 1783 - protein, 15 aa, Brucella spp.
LQQAADGKADAEMKG

SEQ ID NO: 1784 - protein, 8 aa, Brucella spp.
GKVAGKET

SEQ ID NO: 1785 - protein, 8 aa, Brucella spp.
GKKRGDLT

SEQ ID NO: 1786 - protein, 9 aa, Brucella spp.
RDADQASIQ

SEQ ID NO: 1787 - protein, 7 aa, Brucella spp.
LNGGSPK

SEQ ID NO: 1788 - protein, 5 aa, Brucella spp.
VTTNP

SEQ ID NO: 1789 - protein, 5 aa, Brucella spp.
PVSAE

SEQ ID NO: 1790 - protein, 7 aa, Brucella spp.
ALTSEGH

SEQ ID NO: 1791 - protein, 5 aa, Brucella spp.
DTGIN

SEQ ID NO: 1792 - protein, 6 aa, Brucella spp.
TAPPAT

SEQ ID NO: 1793 - protein, 9 aa, Brucella spp.
FGKEAEVSE

SEQ ID NO: 1794 - protein, 7 aa, Brucella spp.
DIKEGDV

SEQ ID NO: 1795 - protein, 18 aa, Brucella spp.
GNPIDGKGPIKAKERRRV

SEQ ID NO: 1796 - protein, 4 aa, Brucella spp.
PGII

SEQ ID NO: 1797 - protein, 5 aa, Brucella spp.
HEPMS

SEQ ID NO: 1798 - protein, 4 aa, Brucella spp.
GRGQ

SEQ ID NO: 1799 - protein, 7 aa, Brucella spp.
DRQTGKT

SEQ ID NO: 1800 - protein, 10 aa, Brucella spp.
PIHDNGPDKD

SEQ ID NO: 1801 - protein, 6 aa, Brucella spp.
QKRSTV

SEQ ID NO: 1802 - protein, 8 aa, Brucella spp.
TASDPAPM

SEQ ID NO: 1803 - protein, 9 aa, Brucella spp.
RPPGREAYP

SEQ ID NO: 1804 - protein, 11 aa, Brucella spp.
KLNDENGAGSL

SEQ ID NO: 1805 - protein, 6 aa, Brucella spp.
TQGNDV

SEQ ID NO: 1806 - protein, 8 aa, Brucella spp.
RVGSSAQI

SEQ ID NO: 1807 - protein, 7 aa, Brucella spp.
AGSIKGE

SEQ ID NO: 1808 - protein, 5 aa, Brucella spp.
LDAAT

SEQ ID NO: 1809 - protein, 10 aa, Brucella spp.
PQFSPLKTEE

SEQ ID NO: 1810 - protein, 6 aa, Brucella spp.
ALTDDL

SEQ ID NO: 1811 - protein, 7 aa, Brucella spp.
KATQKIT

SEQ ID NO: 1812 - protein, 16 aa, Brucella spp.
RRAQEAAEAARPYSQR

SEQ ID NO: 1813 - protein, 8 aa, Brucella spp.
NVSGEDAP

SEQ ID NO: 1814 - protein, 4 aa, Brucella spp.
TGKD

SEQ ID NO: 1815 - protein, 6 aa, Brucella spp.
KKGADI

SEQ ID NO: 1816 - protein, 14 aa, Brucella spp.
PASADNEAEMETAG

SEQ ID NO: 1817 - protein, 6 aa, Brucella spp.
YEPDPA

SEQ ID NO: 1818 - protein, 9 aa, Brucella spp.
DNATRNAGD

SEQ ID NO: 1819 - protein, 8 aa, Brucella spp.
NRQRQAQI

SEQ ID NO: 1820 - protein, 40 aa, Brucella spp.
AAEAKPAAKAPAKKAAPKTTAAAKPAATKSGAPKAAAAGA

SEQ ID NO: 1821 - protein, 4 aa, Brucella spp.
DNQG

SEQ ID NO: 1822 - protein, 4 aa, Brucella spp.
GEDT

SEQ ID NO: 1823 - protein, 11 aa, Brucella spp.
RGQEARDTGEP

SEQ ID NO: 1824 - protein, 16 aa, Brucella spp.
PVDEAGPIKTKATRAI

SEQ ID NO: 1825 - protein, 8 aa, Brucella spp.
EYIEQSTE

SEQ ID NO: 1826 - protein, 6 aa, Brucella spp.
YAKGGK

SEQ ID NO: 1827 - protein, 6 aa, Brucella spp.
KAHGGY

SEQ ID NO: 1828 - protein, 9 aa, Brucella spp.
GERTREGND

SEQ ID NO: 1829 - protein, 11 aa, Brucella spp.
NKLGGGEGSKA

SEQ ID NO: 1830 - protein, 8 aa, Brucella spp.
NEPPGARA

SEQ ID NO: 1831 - protein, 5 aa, Brucella spp.
FRDQG

SEQ ID NO: 1832 - protein, 5 aa, Brucella spp.
AGSEV

SEQ ID NO: 1833 - protein, 6 aa, Brucella spp.
GYQPTL

SEQ ID NO: 1834 - protein, 11 aa, Brucella spp.
ITTTTKGSITS

SEQ ID NO: 1835 - protein, 10 aa, Brucella spp.
DLTDPAPATS

SEQ ID NO: 1836 - protein, 7 aa, Brucella spp.
PLDSTSR

SEQ ID NO: 1837 - protein, 7 aa, Brucella spp.
LSEEDKL

SEQ ID NO: 1838 - protein, 6 aa, Brucella spp.
TGSPGK

SEQ ID NO: 1839 - protein, 14 aa, Brucella spp.
EALEKAKKLAAEAA

SEQ ID NO: 1840 - protein, 4 aa, Brucella spp.
GSEG

SEQ ID NO: 1841 - protein, 7 aa, Brucella spp.
ADGKTDS

SEQ ID NO: 1842 - protein, 4 aa, Brucella spp.
TPQG

SEQ ID NO: 1843 - protein, 11 aa, Brucella spp.
EDASSNEHRTK

SEQ ID NO: 1844 - protein, 12 aa, Brucella spp.
DESYQVGRGPHL

SEQ ID NO: 1845 - protein, 7 aa, Brucella spp.
GADAIHP

SEQ ID NO: 1846 - protein, 5 aa, Brucella spp.
ESPEF

SEQ ID NO: 1847 - protein, 6 aa, Brucella spp.
KPETMR

SEQ ID NO: 1848 - protein, 10 aa, Brucella spp.
ATDPLPDDMD

SEQ ID NO: 1849 - protein, 8 aa, Brucella spp.
WGGGGRGM

SEQ ID NO: 1850 - protein, 11 aa, Brucella spp.
AKREAKAAFGK

SEQ ID NO: 1851 - protein, 5 aa, Brucella spp.
IQRRN

SEQ ID NO: 1852 - protein, 8 aa, Brucella spp.
ERAPAPYL

SEQ ID NO: 1853 - protein, 6 aa, Brucella spp.
AQRREL

SEQ ID NO: 1854 - protein, 12 aa, Brucella spp.
GTPESGVPRQED

SEQ ID NO: 1855 - protein, 8 aa, Brucella spp.
TTEDPEQN

SEQ ID NO: 1856 - protein, 6 aa, Brucella spp.
GGTAYS

SEQ ID NO: 1857 - protein, 7 aa, Brucella spp.
ASGATPL

SEQ ID NO: 1858 - protein, 6 aa, Brucella spp.
RQDRAT

SEQ ID NO: 1859 - protein, 21 aa, Brucella spp.
NGHPETKGRAKPARDAAKPRV

SEQ ID NO: 1860 - protein, 5 aa, Brucella spp.
ADGTK

SEQ ID NO: 1861 - protein, 6 aa, Brucella spp.
TMRDGH

SEQ ID NO: 1862 - protein, 4 aa, Brucella spp.
EGAP

SEQ ID NO: 1863 - protein, 11 aa, Brucella spp.
NGVGYKSYPDN

SEQ ID NO: 1864 - protein, 6 aa, Brucella spp.
NPDRAK

SEQ ID NO: 1865 - protein, 5 aa, Brucella spp.
EVEKA

SEQ ID NO: 1866 - protein, 4 aa, Brucella spp.
EETD

SEQ ID NO: 1867 - protein, 7 aa, Brucella spp.
DTSGISA

SEQ ID NO: 1868 - protein, 10 aa, Brucella spp.
ALSGNTSQPC

SEQ ID NO: 1869 - protein, 10 aa, Brucella spp.
GSERDSGLDP

SEQ ID NO: 1870 - protein, 8 aa, Brucella spp.
DLKGPASE

SEQ ID NO: 1871 - protein, 7 aa, Brucella spp.
KEQARSL

SEQ ID NO: 1872 - protein, 6 aa, Brucella spp.
TPSSKV

SEQ ID NO: 1873 - protein, 7 aa, Brucella spp.
VENPAKD

SEQ ID NO: 1874 - protein, 11 aa, Brucella spp.
LGQPPSGWPEA

SEQ ID NO: 1875 - protein, 9 aa, Brucella spp.
KDEKPFTVR

SEQ ID NO: 1876 - protein, 21 aa, Brucella spp.
DLDAERKSFEDSVGRKLSDQE

SEQ ID NO: 1877 - protein, 10 aa, Brucella spp.
AHETYGPTSV

SEQ ID NO: 1878 - protein, 8 aa, Brucella spp.
MSETDEKG

SEQ ID NO: 1879 - protein, 5 aa, Brucella spp.
GQPRR

SEQ ID NO: 1880 - protein, 27 aa, Brucella spp.
PNRAKGASGGVRRKVEAGNDKQVGAPM

SEQ ID NO: 1881 - protein, 6 aa, Brucella spp.
QKVTQG

SEQ ID NO: 1882 - protein, 6 aa, Brucella spp.
AERDGT

SEQ ID NO: 1883 - protein, 15 aa, Brucella spp.
GEQIDAKDLLIVYAE

SEQ ID NO: 1884 - protein, 12 aa, Brucella spp.
TNTDTADVDSTV

SEQ ID NO: 1885 - protein, 9 aa, Brucella spp.
RDESAAAVP

SEQ ID NO: 1886 - protein, 16 aa, Brucella spp.
INPGNVGFKDKKDKQF

SEQ ID NO: 1887 - protein, 11 aa, Brucella spp.
NQAEGAPLSAQ

SEQ ID NO: 1888 - protein, 7 aa, Brucella spp.
AGMGTKG

SEQ ID NO: 1889 - protein, 12 aa, Brucella spp.
TPEPGGDRTREV

SEQ ID NO: 1890 - protein, 8 aa, Brucella spp.
GCGRTTST

SEQ ID NO: 1891 - protein, 8 aa, Brucella spp.
GPGESKHA

SEQ ID NO: 1892 - protein, 11 aa, Brucella spp.
LPGTGETPSAP

SEQ ID NO: 1893 - protein, 10 aa, Brucella spp.
VTTLRGPGIA

SEQ ID NO: 1894 - protein, 6 aa, Brucella spp.
QRQDGA

SEQ ID NO: 1895 - protein, 6 aa, Brucella spp.
SGKAYG

SEQ ID NO: 1896 - protein, 4 aa, Brucella spp.
GTGS

SEQ ID NO: 1897 - protein, 7 aa, Brucella spp.
NQAKDRP

SEQ ID NO: 1898 - protein, 6 aa, Brucella spp.
GVSGGR

SEQ ID NO: 1899 - protein, 4 aa, Brucella spp.
DGEI

SEQ ID NO: 1900 - protein, 13 aa, Brucella spp.
ISGDTSDNDEAAA

SEQ ID NO: 1901 - protein, 18 aa, Brucella spp.
PLAPRNVPSGIDKKPVAG

SEQ ID NO: 1902 - protein, 14 aa, Brucella spp.
DAQGDRKVHGGPEK

SEQ ID NO: 1903 - protein, 26 aa, Brucella spp.
IGENSRLDQPGAFGENISTSGLDEND

SEQ ID NO: 1904 - protein, 5 aa, Brucella spp.
QGRQP

SEQ ID NO: 1905 - protein, 6 aa, Brucella spp.
KTGRTG

SEQ ID NO: 1906 - protein, 5 aa, Brucella spp.
VEAGE

SEQ ID NO: 1907 - protein, 18 aa, Brucella spp.
GHGPESGNSLGGQTGSPD

SEQ ID NO: 1908 - protein, 9 aa, Brucella spp.
GPSGSGKST

SEQ ID NO: 1909 - protein, 5 aa, Brucella spp.
ETPQS

SEQ ID NO: 1910 - protein, 7 aa, Brucella spp.
LPPADRP

SEQ ID NO: 1911 - protein, 6 aa, Brucella spp.
LGRSPN

SEQ ID NO: 1912 - protein, 10 aa, Brucella spp.
LNEEDRKAVA

SEQ ID NO: 1913 - protein, 19 aa, Brucella spp.
LQGKEKRKPEALSGGERQR

SEQ ID NO: 1914 - protein, 4 aa, Brucella spp.
RRET

SEQ ID NO: 1915 - protein, 4 aa, Brucella spp.
TPED

SEQ ID NO: 1916 - protein, 9 aa, Brucella spp.
IAAQGPATE

SEQ ID NO: 1917 - protein, 6 aa, Brucella spp.
RAGPEA

SEQ ID NO: 1918 - protein, 5 aa, Brucella spp.
SGISH

SEQ ID NO: 1919 - protein, 7 aa, Brucella spp.
SASAELQ

SEQ ID NO: 1920 - protein, 13 aa, Brucella spp.
KRFPSAKDMTDGE

SEQ ID NO: 1921 - protein, 4 aa, Brucella spp.
ARGA

SEQ ID NO: 1922 - protein, 7 aa, Brucella spp.
GGQRTDH

SEQ ID NO: 1923 - protein, 7 aa, Brucella spp.
AQAARGR

SEQ ID NO: 1924 - protein, 12 aa, Brucella spp.
SGAEEAWPLPPG

SEQ ID NO: 1925 - protein, 4 aa, Brucella spp.
DGTP

SEQ ID NO: 1926 - protein, 10 aa, Brucella spp.
EEEKKTIGDD

SEQ ID NO: 1927 - protein, 7 aa, Brucella spp.
KGSGFDS

SEQ ID NO: 1928 - protein, 10 aa, Brucella spp.
KEDHERQEEE

SEQ ID NO: 1929 - protein, 25 aa, Brucella spp.
HTGAGVSKQSAQEKPVSAAQTPEER

SEQ ID NO: 1930 - protein, 11 aa, Brucella spp.
HTANEAKARRI

SEQ ID NO: 1931 - protein, 5 aa, Brucella spp.
SGSAT

SEQ ID NO: 1932 - protein, 4 aa, Brucella spp.
KNFN

SEQ ID NO: 1933 - protein, 6 aa, Brucella spp.
AGCPAA

SEQ ID NO: 1934 - protein, 6 aa, Brucella spp.
DDPKAL

SEQ ID NO: 1935 - protein, 6 aa, Brucella spp.
ADKLAE

SEQ ID NO: 1936 - protein, 6 aa, Brucella spp.
SGIETA

SEQ ID NO: 1937 - protein, 4 aa, Brucella spp.
LGGR

SEQ ID NO: 1938 - protein, 7 aa, Brucella spp.
YDGKGQV

SEQ ID NO: 1939 - protein, 5 aa, Brucella spp.
DETQA

SEQ ID NO: 1940 - protein, 6 aa, Brucella spp.
RDRSGN

SEQ ID NO: 1941 - protein, 5 aa, Brucella spp.
TSTVP

SEQ ID NO: 1942 - protein, 9 aa, Brucella spp.
TAEAARTAA

SEQ ID NO: 1943 - protein, 8 aa, Brucella spp.
LGNTDRHS

SEQ ID NO: 1944 - protein, 8 aa, Brucella spp.
KEARAGRK

SEQ ID NO: 1945 - protein, 5 aa, Brucella spp.
HRTPD

SEQ ID NO: 1946 - protein, 6 aa, Brucella spp.
GAKAEG

SEQ ID NO: 1947 - protein, 7 aa, Brucella spp.
AGGAAHL

SEQ ID NO: 1948 - protein, 9 aa, Brucella spp.
SKALSGQDS

SEQ ID NO: 1949 - protein, 15 aa, Brucella spp.
KAQTESVAERPSNEA

SEQ ID NO: 1950 - protein, 5 aa, Brucella spp.
QEHAD

SEQ ID NO: 1951 - protein, 13 aa, Brucella spp.
QEMEDQVIPDIIA

SEQ ID NO: 1952 - protein, 8 aa, Brucella spp.
KHGALEEE

SEQ ID NO: 1953 - protein, 4 aa, Brucella spp.
ASPA

SEQ ID NO: 1954 - protein, 8 aa, Brucella spp.
NPRGTVQG

SEQ ID NO: 1955 - protein, 13 aa, Brucella spp.
RATSSGIPIELAK

SEQ ID NO: 1956 - protein, 7 aa, Brucella spp.
RRRQDER

SEQ ID NO: 1957 - protein, 6 aa, Brucella spp.
DGLPKD

SEQ ID NO: 1958 - protein, 14 aa, Brucella spp.
KEGDFAEAEEEVQR

SEQ ID NO: 1959 - protein, 28 aa, Brucella spp.
ADRSRLAQELDQSEARAERLEAANREVS

SEQ ID NO: 1960 - protein, 7 aa, Brucella spp.
EGQEEHL

SEQ ID NO: 1961 - protein, 27 aa, Brucella spp.
GLENEAETLRRSRDEALSRADSNDAAL

SEQ ID NO: 1962 - protein, 5 aa, Brucella spp.
LDPRY

SEQ ID NO: 1963 - protein, 10 aa, Brucella spp.
AAAKKGEAAI

SEQ ID NO: 1964 - protein, 4 aa, Brucella spp.
DPRP

SEQ ID NO: 1965 - protein, 9 aa, Brucella spp.
TMGPDEHAP

SEQ ID NO: 1966 - protein, 5 aa, Brucella spp.
PNEPH

SEQ ID NO: 1967 - protein, 6 aa, Brucella spp.
PRSETI

SEQ ID NO: 1968 - protein, 8 aa, Brucella spp.
EIEPGTKL

SEQ ID NO: 1969 - protein, 7 aa, Brucella spp.
VSEPRRG

SEQ ID NO: 1970 - protein, 17 aa, Brucella spp.
AEQATLEGDKSRDVRSW

SEQ ID NO: 1971 - protein, 6 aa, Brucella spp.
ARTDHD

SEQ ID NO: 1972 - protein, 6 aa, Brucella spp.
NDIESA

SEQ ID NO: 1973 - protein, 16 aa, Brucella spp.
VKTASGKVRDSFAIVG

SEQ ID NO: 1974 - protein, 13 aa, Brucella spp.
NAVKPGKGGAYNQ

SEQ ID NO: 1975 - protein, 16 aa, Brucella spp.
DPVVKGQTAASSYKPA

SEQ ID NO: 1976 - protein, 13 aa, Brucella spp.
YLDGEGREEARNL

SEQ ID NO: 1977 - protein, 17 aa, Brucella spp.
ARSGEMTRPQVSAEKAE

SEQ ID NO: 1978 - protein, 14 aa, Brucella spp.
RLDTPSAGEAAPGW

SEQ ID NO: 1979 - protein, 7 aa, Brucella spp.
PRGNPVS

SEQ ID NO: 1980 - protein, 8 aa, Brucella spp.
GTVTSNAE

SEQ ID NO: 1981 - protein, 6 aa, Brucella spp.
DATATL

SEQ ID NO: 1982 - protein, 5 aa, Brucella spp.
AQAGL

SEQ ID NO: 1983 - protein, 6 aa, Brucella spp.
YAPNAV

SEQ ID NO: 1984 - protein, 5 aa, Brucella spp.
HGEKQ

SEQ ID NO: 1985 - protein, 8 aa, Brucella spp.
FDTSDAAD

SEQ ID NO: 1986 - protein, 8 aa, Brucella spp.
GNLGGAGE

SEQ ID NO: 1987 - protein, 6 aa, Brucella spp.
LSPSEL

SEQ ID NO: 1988 - protein, 8 aa, Brucella spp.
RAPGVGKK

SEQ ID NO: 1989 - protein, 15 aa, Brucella spp.
NKAPAFAGEASGTIG

SEQ ID NO: 1990 - protein, 12 aa, Brucella spp.
LGAGAAPAPVAD

SEQ ID NO: 1991 - protein, 11 aa, Brucella spp.
GYSRDQAANAV

SEQ ID NO: 1992 - protein, 11 aa, Brucella spp.
LKETGEGADSA

SEQ ID NO: 1993 - protein, 13 aa, Brucella spp.
RRADEDNTLRPQT

SEQ ID NO: 1994 - protein, 5 aa, Brucella spp.
AAARA

SEQ ID NO: 1995 - protein, 5 aa, Brucella spp.
VRGEA

SEQ ID NO: 1996 - protein, 7 aa, Brucella spp.
PPGLGKT

SEQ ID NO: 1997 - protein, 7 aa, Brucella spp.
STSGPVI

SEQ ID NO: 1998 - protein, 8 aa, Brucella spp.
EGPAARSV

SEQ ID NO: 1999 - protein, 17 aa, Brucella spp.
SSDGAREVARRSRGTPR

SEQ ID NO: 2000 - protein, 5 aa, Brucella spp.
NRGLD

SEQ ID NO: 2001 - protein, 5 aa, Brucella spp.
GGGPV

SEQ ID NO: 2002 - protein, 8 aa, Brucella spp.
GLSEPRDA

SEQ ID NO: 2003 - protein, 6 aa, Brucella spp.
RTPRGR

SEQ ID NO: 2004 - protein, 4 aa, Brucella spp.
ELKD

SEQ ID NO: 2005 - protein, 5 aa, Brucella spp.
EGSLG

SEQ ID NO: 2006 - protein, 4 aa, Brucella spp.
APAR

SEQ ID NO: 2007 - protein, 7 aa, Brucella spp.
EGHPRRI

SEQ ID NO: 2008 - protein, 6 aa, Brucella spp.
CGSDAV

SEQ ID NO: 2009 - protein, 7 aa, Brucella spp.
VSGGSDS

SEQ ID NO: 2010 - protein, 4 aa, Brucella spp.
LESP

SEQ ID NO: 2011 - protein, 8 aa, Brucella spp.
AESALEAE

SEQ ID NO: 2012 - protein, 8 aa, Brucella spp.
DPKPAHGL

SEQ ID NO: 2013 - protein, 5 aa, Brucella spp.
AARTA

SEQ ID NO: 2014 - protein, 6 aa, Brucella spp.
ARDAGA

SEQ ID NO: 2015 - protein, 6 aa, Brucella spp.
HTENDQ

SEQ ID NO: 2016 - protein, 7 aa, Brucella spp.
RSGHCEA

SEQ ID NO: 2017 - protein, 10 aa, Brucella spp.
DPSNANIDYE

SEQ ID NO: 2018 - protein, 8 aa, Brucella spp.
AEADGQEV

SEQ ID NO: 2019 - protein, 11 aa, Brucella spp.
QAGAARERNNA

SEQ ID NO: 2020 - protein, 6 aa, Brucella spp.
DPATLG

SEQ ID NO: 2021 - protein, 6 aa, Brucella spp.
LSPGAR

SEQ ID NO: 2022 - protein, 8 aa, Brucella spp.
PGDGERRR

SEQ ID NO: 2023 - protein, 7 aa, Brucella spp.
GQDAPRR

SEQ ID NO: 2024 - protein, 9 aa, Brucella spp.
RGEKGAPHR

SEQ ID NO: 2025 - protein, 4 aa, Brucella spp.
RRNL

SEQ ID NO: 2026 - protein, 7 aa, Brucella spp.
IAPPGRQ

SEQ ID NO: 2027 - protein, 8 aa, Brucella spp.
SGRDIESR

SEQ ID NO: 2028 - protein, 16 aa, Brucella spp.
ANPNFSSGPCAKRPGW

SEQ ID NO: 2029 - protein, 17 aa, Brucella spp.
DAPLGRSHRAKIGKNKL

SEQ ID NO: 2030 - protein, 6 aa, Brucella spp.
ASDTGA

SEQ ID NO: 2031 - protein, 8 aa, Brucella spp.
GTTSGVRV

SEQ ID NO: 2032 - protein, 5 aa, Brucella spp.
GGEGA

SEQ ID NO: 2033 - protein, 8 aa, Brucella spp.
KPETRSNT

SEQ ID NO: 2034 - protein, 7 aa, Brucella spp.
SADEQAA

SEQ ID NO: 2035 - protein, 7 aa, Brucella spp.
YRDAPSG

SEQ ID NO: 2036 - protein, 5 aa, Brucella spp.
VEASD

SEQ ID NO: 2037 - protein, 7 aa, Brucella spp.
GDEGKGK

SEQ ID NO: 2038 - protein, 6 aa, Brucella spp.
GGHNAG

SEQ ID NO: 2039 - protein, 7 aa, Brucella spp.
LRGQGID

SEQ ID NO: 2040 - protein, 28 aa, Brucella spp.
MREGSNSGLKIGTTKRGIGPAYEDKVGR

SEQ ID NO: 2041 - protein, 7 aa, Brucella spp.
EPETLRP

SEQ ID NO: 2042 - protein, 5 aa, Brucella spp.
RRKAG

SEQ ID NO: 2043 - protein, 6 aa, Brucella spp.
NDHGTY

SEQ ID NO: 2044 - protein, 18 aa, Brucella spp.
SNTVAGQAAAGSGLGPTA

SEQ ID NO: 2045 - protein, 14 aa, Brucella spp.
YTTRVGEGPFPTEL

SEQ ID NO: 2046 - protein, 5 aa, Brucella spp.
RTSGI

SEQ ID NO: 2047 - protein, 5 aa, Brucella spp.
SMGAQ

SEQ ID NO: 2048 - protein, 11 aa, Brucella spp.
WSETTAGARSW

SEQ ID NO: 2049 - protein, 5 aa, Brucella spp.
DLPAQ

SEQ ID NO: 2050 - protein, 18 aa, Brucella spp.
STSPEREDTILVTDPFHD

SEQ ID NO: 2051 - protein, 10 aa, Brucella spp.
AYETAGSAGM

SEQ ID NO: 2052 - protein, 11 aa, Brucella spp.
TPGTIDSDYRG

SEQ ID NO: 2053 - protein, 23 aa, Brucella spp.
IEERAKISETARGAGGFGSTGTA

SEQ ID NO: 2054 - protein, 11 aa, Brucella spp.
LTGSQSSGDAY

SEQ ID NO: 2055 - protein, 6 aa, Brucella spp.
EASSDR

SEQ ID NO: 2056 - protein, 7 aa, Brucella spp.
RMPETSS

SEQ ID NO: 2057 - protein, 9 aa, Brucella spp.
TASGEISRQ

SEQ ID NO: 2058 - protein, 5 aa, Brucella spp.
RTKDE

SEQ ID NO: 2059 - protein, 4 aa, Brucella spp.
EKPR

SEQ ID NO: 2060 - protein, 8 aa, Brucella spp.
ADGSSGID

SEQ ID NO: 2061 - protein, 7 aa, Brucella spp.
GERPEPT

SEQ ID NO: 2062 - protein, 4 aa, Brucella spp.
GKRL

SEQ ID NO: 2063 - protein, 7 aa, Brucella spp.
GPELSRS

SEQ ID NO: 2064 - protein, 14 aa, Brucella spp.
DGAPARETKQKLRE

SEQ ID NO: 2065 - protein, 12 aa, Brucella spp.
EPEPAEPQGENI

SEQ ID NO: 2066 - protein, 7 aa, Brucella spp.
GNGNWTG

SEQ ID NO: 2067 - protein, 5 aa, Brucella spp.
LSGIG

SEQ ID NO: 2068 - protein, 5 aa, Brucella spp.
KDTSG

SEQ ID NO: 2069 - protein, 5 aa, Brucella spp.
DRAHR

SEQ ID NO: 2070 - protein, 9 aa, Brucella spp.
DHGRTGDLE

SEQ ID NO: 2071 - protein, 7 aa, Brucella spp.
ERPQGTV

SEQ ID NO: 2072 - protein, 9 aa, Brucella spp.
RSHRDRTKQ

SEQ ID NO: 2073 - protein, 7 aa, Brucella spp.
EEREDAR

SEQ ID NO: 2074 - protein, 9 aa, Brucella spp.
FSPREDATA

SEQ ID NO: 2075 - protein, 4 aa, Brucella spp.
TGRT

SEQ ID NO: 2076 - protein, 16 aa, Brucella spp.
GSAYKTKANKLPEPLK

SEQ ID NO: 2077 - protein, 6 aa, Brucella spp.
GDGGLT

SEQ ID NO: 2078 - protein, 9 aa, Brucella spp.
EHADPKAAH

SEQ ID NO: 2079 - protein, 6 aa, Brucella spp.
GTTANQ

SEQ ID NO: 2080 - protein, 13 aa, Brucella spp.
QALDDGDLNPDQV

SEQ ID NO: 2081 - protein, 5 aa, Brucella spp.
VSEDE

SEQ ID NO: 2082 - protein, 21 aa, Brucella spp.
LSGDASLNAPLRASEGESGEW

SEQ ID NO: 2083 - protein, 7 aa, Brucella spp.
DSNSQEQ

SEQ ID NO: 2084 - protein, 6 aa, Brucella spp.
ELESRR

SEQ ID NO: 2085 - protein, 18 aa, Brucella spp.
AAAHKQQKALNHIEEAHV

SEQ ID NO: 2086 - protein, 5 aa, Brucella spp.
RNRDG

SEQ ID NO: 2087 - protein, 8 aa, Brucella spp.
NARGGGIG

SEQ ID NO: 2088 - protein, 5 aa, Brucella spp.
AGNAA

SEQ ID NO: 2089 - protein, 10 aa, Brucella spp.
EAAPGTGVEP

SEQ ID NO: 2090 - protein, 4 aa, Brucella spp.
PKNR

SEQ ID NO: 2091 - protein, 4 aa, Brucella spp.
DELQ

SEQ ID NO: 2092 - protein, 12 aa, Brucella spp.
ENRDKGYSQADY

SEQ ID NO: 2093 - protein, 8 aa, Brucella spp.
VSTTNVDP

SEQ ID NO: 2094 - protein, 4 aa, Brucella spp.
NARW

SEQ ID NO: 2095 - protein, 22 aa, Brucella spp.
DAISEADGAEKGKGYNPKRGEK

SEQ ID NO: 2096 - protein, 9 aa, Brucella spp.
ESAPLSTGK

SEQ ID NO: 2097 - protein, 25 aa, Brucella spp.
DGSATTLKDESQFKGYNGDAASPTN

SEQ ID NO: 2098 - protein, 10 aa, Brucella spp.
HPIGKTDPAH

SEQ ID NO: 2099 - protein, 5 aa, Brucella spp.
VDAED

SEQ ID NO: 2100 - protein, 14 aa, Brucella spp.
EDTFEKNGKQMTRR

SEQ ID NO: 2101 - protein, 15 aa, Brucella spp.
NGDRTYTAPDGSTLT

SEQ ID NO: 2102 - protein, 8 aa, Brucella spp.
AEGNEVPE

SEQ ID NO: 2103 - protein, 12 aa, Brucella spp.
GPNGRHMNSREG

SEQ ID NO: 2104 - protein, 5 aa, Brucella spp.
MHGPE

SEQ ID NO: 2105 - protein, 6 aa, Brucella spp.
ERRTTV

SEQ ID NO: 2106 - protein, 7 aa, Brucella spp.
RTGDEIH

SEQ ID NO: 2107 - protein, 10 aa, Brucella spp.
AHPKAGANTA

SEQ ID NO: 2108 - protein, 8 aa, Brucella spp.
VPSPTAAT

SEQ ID NO: 2109 - protein, 8 aa, Brucella spp.
LKSRPRAK

SEQ ID NO: 2110 - protein, 6 aa, Brucella spp.
PNWTPD

SEQ ID NO: 2111 - protein, 6 aa, Brucella spp.
DNNAQG

SEQ ID NO: 2112 - protein, 4 aa, Brucella spp.
KVPD

SEQ ID NO: 2113 - protein, 8 aa, Brucella spp.
KQNEGDPL

SEQ ID NO: 2114 - protein, 9 aa, Brucella spp.
GREQPNGYT

SEQ ID NO: 2115 - protein, 4 aa, Brucella spp.
PNGQ

SEQ ID NO: 2116 - protein, 7 aa, Brucella spp.
MAEQSGG

SEQ ID NO: 2117 - protein, 4 aa, Brucella spp.
ARCT

SEQ ID NO: 2118 - protein, 7 aa, Brucella spp.
VRRQSEH

SEQ ID NO: 2119 - protein, 31 aa, Brucella spp.
EACARGDDWPSDPDGTPLYPQDERNMSEKEQ

SEQ ID NO: 2120 - protein, 6 aa, Brucella spp.
LASAGE

SEQ ID NO: 2121 - protein, 19 aa, Brucella spp.
SGAGPDGETGRLAADPARW

SEQ ID NO: 2122 - protein, 8 aa, Brucella spp.
RKDTPTSY

SEQ ID NO: 2123 - protein, 15 aa, Brucella spp.
EDGQKLSKSRKDTAL

SEQ ID NO: 2124 - protein, 7 aa, Brucella spp.
PKGRFDG

SEQ ID NO: 2125 - protein, 6 aa, Brucella spp.
AHTAED

SEQ ID NO: 2126 - protein, 5 aa, Brucella spp.
LSGNQ

SEQ ID NO: 2127 - protein, 10 aa, Brucella spp.
ADANTASAMY

SEQ ID NO: 2128 - protein, 10 aa, Brucella spp.
YPANAGPELA

SEQ ID NO: 2129 - protein, 12 aa, Brucella spp.
DQIETAEGKGLS

SEQ ID NO: 2130 - protein, 7 aa, Brucella spp.
EAGFGDP

SEQ ID NO: 2131 - protein, 10 aa, Brucella spp.
LASEKKCGHL

SEQ ID NO: 2132 - protein, 6 aa, Brucella spp.
TDAEAA

SEQ ID NO: 2133 - protein, 8 aa, Brucella spp.
DIDERDQP

SEQ ID NO: 2134 - protein, 7 aa, Brucella spp.
AGRTAEG

SEQ ID NO: 2135 - protein, 7 aa, Brucella spp.
SKPDLAQ

SEQ ID NO: 2136 - protein, 5 aa, Brucella spp.
KAHPG

SEQ ID NO: 2137 - protein, 4 aa, Brucella spp.
LDDA

SEQ ID NO: 2138 - protein, 5 aa, Brucella spp.
YKDRQ

SEQ ID NO: 2139 - protein, 17 aa, Brucella spp.
AEADGYTATKHQREVGT

SEQ ID NO: 2140 - protein, 25 aa, Brucella spp.
ITGGQSSTTAMKESTETAQFKPAAE

SEQ ID NO: 2141 - protein, 6 aa, Brucella spp.
EGFARG

SEQ ID NO: 2142 - protein, 10 aa, Brucella spp.
SSENTSAPSA

SEQ ID NO: 2143 - protein, 18 aa, Brucella spp.
MPDNSAEAAISGLGDDST

SEQ ID NO: 2144 - protein, 6 aa, Brucella spp.
GDATDR

SEQ ID NO: 2145 - protein, 9 aa, Brucella spp.
RTGSHSVPG

SEQ ID NO: 2146 - protein, 6 aa, Brucella spp.
PAQFQT

SEQ ID NO: 2147 - protein, 8 aa, Brucella spp.
VPLPDNAE

SEQ ID NO: 2148 - protein, 23 aa, Brucella spp.
PEQGDAPAQQAQKTHAEQPRPKT

SEQ ID NO: 2149 - protein, 5 aa, Brucella spp.
DAPPA

SEQ ID NO: 2150 - protein, 8 aa, Brucella spp.
PDGTFSEI

SEQ ID NO: 2151 - protein, 7 aa, Brucella spp.
VGPNSAD

SEQ ID NO: 2152 - protein, 4 aa, Brucella spp.
TDGS

SEQ ID NO: 2153 - protein, 10 aa, Brucella spp.
AEAEADPEEI

SEQ ID NO: 2154 - protein, 17 aa, Brucella spp.
GIPQNRKPRKEPAETAR

SEQ ID NO: 2155 - protein, 8 aa, Brucella spp.
VANDDHPA

SEQ ID NO: 2156 - protein, 17 aa, Brucella spp.
KPPLDITPTPGRRDSDK

SEQ ID NO: 2157 - protein, 8 aa, Brucella spp.
QEKVAANQ

SEQ ID NO: 2158 - protein, 19 aa, Brucella spp.
EKERATRPEGGLTKTERNA

SEQ ID NO: 2159 - protein, 41 aa, Brucella spp.
QGLANTRAESETPVSETSSIEPVEPTPPVKTRSEPIQPDET

SEQ ID NO: 2160 - protein, 6 aa, Brucella spp.
IRSAGG

SEQ ID NO: 2161 - protein, 10 aa, Brucella spp.
SESDDGETRQ

SEQ ID NO: 2162 - protein, 8 aa, Brucella spp.
DGSEEPVD

SEQ ID NO: 2163 - protein, 19 aa, Brucella spp.
DLPAPAELPAANDEEKQAL

SEQ ID NO: 2164 - protein, 6 aa, Brucella spp.
RDEAEG

SEQ ID NO: 2165 - protein, 7 aa, Brucella spp.
IGREAKG

SEQ ID NO: 2166 - protein, 22 aa, Brucella spp.
RTEEELTNARKEAERASNQKTE

SEQ ID NO: 2167 - protein, 8 aa, Brucella spp.
FGPIGNDR

SEQ ID NO: 2168 - protein, 4 aa, Brucella spp.
NRSG

SEQ ID NO: 2169 - protein, 5 aa, Brucella spp.
PQANR

SEQ ID NO: 2170 - protein, 4 aa, Brucella spp.
SRSI

SEQ ID NO: 2171 - protein, 5 aa, Brucella spp.
TAPGG

SEQ ID NO: 2172 - protein, 5 aa, Brucella spp.
GIGMS

SEQ ID NO: 2173 - protein, 6 aa, Brucella spp.
KSEVEQ

SEQ ID NO: 2174 - protein, 17 aa, Brucella spp.
RRKAESAKDWRNEGTGL

SEQ ID NO: 2175 - protein, 8 aa, Brucella spp.
DSNPGQGT

SEQ ID NO: 2176 - protein, 5 aa, Brucella spp.
NGTDA

SEQ ID NO: 2177 - protein, 4 aa, Brucella spp.
PDSY

SEQ ID NO: 2178 - protein, 7 aa, Brucella spp.
KEGRLEP

SEQ ID NO: 2179 - protein, 9 aa, Brucella spp.
AQSIGGKRD

SEQ ID NO: 2180 - protein, 4 aa, Brucella spp.
CYGD

SEQ ID NO: 2181 - protein, 7 aa, Brucella spp.
KGETQYD

SEQ ID NO: 2182 - protein, 9 aa, Brucella spp.
ELPAGNRSA

SEQ ID NO: 2183 - protein, 11 aa, Brucella spp.
IESENRDGLKA

SEQ ID NO: 2184 - protein, 5 aa, Brucella spp.
LQAEG

SEQ ID NO: 2185 - protein, 13 aa, Brucella spp.
VAPGGLPVSESLP

SEQ ID NO: 2186 - protein, 6 aa, Brucella spp.
EADQDK

SEQ ID NO: 2187 - protein, 5 aa, Brucella spp.
KRRQL

SEQ ID NO: 2188 - protein, 9 aa, Brucella spp.
SEEKKAGIT

SEQ ID NO: 2189 - protein, 7 aa, Brucella spp.
AARQRRD

SEQ ID NO: 2190 - protein, 8 aa, Brucella spp.
QKEAAEAE

SEQ ID NO: 2191 - protein, 21 aa, Brucella spp.
ETELSKAEALEERDGVKAPRE

SEQ ID NO: 2192 - protein, 5 aa, Brucella spp.
PEDTR

SEQ ID NO: 2193 - protein, 6 aa, Brucella spp.
GGVDSS

SEQ ID NO: 2194 - protein, 12 aa, Brucella spp.
GQDIEDARRVSE

SEQ ID NO: 2195 - protein, 7 aa, Brucella spp.
VSGETPI

SEQ ID NO: 2196 - protein, 7 aa, Brucella spp.
RDLGADA

SEQ ID NO: 2197 - protein, 6 aa, Brucella spp.
RANGAH

SEQ ID NO: 2198 - protein, 7 aa, Brucella spp.
VDTDRDQ

SEQ ID NO: 2199 - protein, 6 aa, Brucella spp.
KKQDSQ

SEQ ID NO: 2200 - protein, 9 aa, Brucella spp.
KPEAANPGD

SEQ ID NO: 2201 - protein, 4 aa, Brucella spp.
TLGR

SEQ ID NO: 2202 - protein, 7 aa, Brucella spp.
ADLPKSG

SEQ ID NO: 2203 - protein, 8 aa, Brucella spp.
STRPPRPA

SEQ ID NO: 2204 - protein, 7 aa, Brucella spp.
ESGIAPG

SEQ ID NO: 2205 - protein, 5 aa, Brucella spp.
DDSNA

SEQ ID NO: 2206 - protein, 9 aa, Brucella spp.
RSEREPQAE

SEQ ID NO: 2207 - protein, 7 aa, Brucella spp.
RAETRDG

SEQ ID NO: 2208 - protein, 13 aa, Brucella spp.
ASLDSAAESCPEF

SEQ ID NO: 2209 - protein, 7 aa, Brucella spp.
GAGPGTA

SEQ ID NO: 2210 - protein, 4 aa, Brucella spp.
LARH

SEQ ID NO: 2211 - protein, 6 aa, Brucella spp.
APDERE

SEQ ID NO: 2212 - protein, 6 aa, Brucella spp.
PGTPAG

SEQ ID NO: 2213 - protein, 5 aa, Brucella spp.
EVPWE

SEQ ID NO: 2214 - protein, 6 aa, Brucella spp.
EKPAGV

SEQ ID NO: 2215 - protein, 8 aa, Brucella spp.
PPRVGGGK

SEQ ID NO: 2216 - protein, 15 aa, Brucella spp.
QDGQAEERLTTKRDG

SEQ ID NO: 2217 - protein, 7 aa, Brucella spp.
PSASQTD

SEQ ID NO: 2218 - protein, 6 aa, Brucella spp.
GDVPDD

SEQ ID NO: 2219 - protein, 4 aa, Brucella spp.
TSEL

SEQ ID NO: 2220 - protein, 7 aa, Brucella spp.
KAGGGYR

SEQ ID NO: 2221 - protein, 7 aa, Brucella spp.
PESFTGT

SEQ ID NO: 2222 - protein, 6 aa, Brucella spp.
KPTPDN

SEQ ID NO: 2223 - protein, 9 aa, Brucella spp.
HNDRGTGIA

SEQ ID NO: 2224 - protein, 8 aa, Brucella spp.
ADRGEGTL

SEQ ID NO: 2225 - protein, 9 aa, Brucella spp.
GNGERTGNV

SEQ ID NO: 2226 - protein, 5 aa, Brucella spp.
IDPGL

SEQ ID NO: 2227 - protein, 10 aa, Brucella spp.
GSHQDAINKG

SEQ ID NO: 2228 - protein, 10 aa, Brucella spp.
MKARRSANSP

SEQ ID NO: 2229 - protein, 7 aa, Brucella spp.
PQDVGRS

SEQ ID NO: 2230 - protein, 7 aa, Brucella spp.
SQSGKGG

SEQ ID NO: 2231 - protein, 10 aa, Brucella spp.
DEEGKELPSK

SEQ ID NO: 2232 - protein, 5 aa, Brucella spp.
TQPDA

SEQ ID NO: 2233 - protein, 10 aa, Brucella spp.
YPHPEQKGRR

SEQ ID NO: 2234 - protein, 18 aa, Brucella spp.
TDNGVTKTIEGKGTGPID

SEQ ID NO: 2235 - protein, 12 aa, Brucella spp.
HSLQQGSDASAI

SEQ ID NO: 2236 - protein, 9 aa, Brucella spp.
EQDADGRRA

SEQ ID NO: 2237 - protein, 9 aa, Brucella spp.
NRASPRTQS

SEQ ID NO: 2238 - protein, 13 aa, Brucella spp.
NPLEQEGTYPLPE

SEQ ID NO: 2239 - protein, 11 aa, Brucella spp.
SARPDADNEHA

SEQ ID NO: 2240 - protein, 8 aa, Brucella spp.
GPGPRASQ

SEQ ID NO: 2241 - protein, 5 aa, Brucella spp.
APSVD

SEQ ID NO: 2242 - protein, 9 aa, Brucella spp.
RSPRGDELN

SEQ ID NO: 2243 - protein, 7 aa, Brucella spp.
PDVAERP

SEQ ID NO: 2244 - protein, 4 aa, Brucella spp.
LNDD

SEQ ID NO: 2245 - protein, 4 aa, Brucella spp.
GKPV

SEQ ID NO: 2246 - protein, 4 aa, Brucella spp.
KDAP

SEQ ID NO: 2247 - protein, 7 aa, Brucella spp.
RQHYGGN

SEQ ID NO: 2248 - protein, 8 aa, Brucella spp.
GGMGGAQP

SEQ ID NO: 2249 - protein, 4 aa, Brucella spp.
ETRA

SEQ ID NO: 2250 - protein, 7 aa, Brucella spp.
EKTHSLD

SEQ ID NO: 2251 - protein, 8 aa, Brucella spp.
TKAGEAKS

SEQ ID NO: 2252 - protein, 16 aa, Brucella spp.
VKPDIVTDQTSAHDPV

SEQ ID NO: 2253 - protein, 10 aa, Brucella spp.
AKQENDPKVV

SEQ ID NO: 2254 - protein, 6 aa, Brucella spp.
KAARAS

SEQ ID NO: 2255 - protein, 13 aa, Brucella spp.
SGDPEDIAKTDAK

SEQ ID NO: 2256 - protein, 23 aa, Brucella spp.
DSGSVASPNRETEAMKDGSDAVS

SEQ ID NO: 2257 - protein, 5 aa, Brucella spp.
TASGA

SEQ ID NO: 2258 - protein, 8 aa, Brucella spp.
GTEDADRR

SEQ ID NO: 2259 - protein, 14 aa, Brucella spp.
PQSSMREAAGTGGL

SEQ ID NO: 2260 - protein, 17 aa, Brucella spp.
ADAQSGPATKARGIPPV

SEQ ID NO: 2261 - protein, 8 aa, Brucella spp.
RKDEDGKT

SEQ ID NO: 2262 - protein, 8 aa, Brucella spp.
VSGEGETQ

SEQ ID NO: 2263 - protein, 6 aa, Brucella spp.
EAGADH

SEQ ID NO: 2264 - protein, 7 aa, Brucella spp.
EPESGGL

SEQ ID NO: 2265 - protein, 9 aa, Brucella spp.
PDHEELTGD

SEQ ID NO: 2266 - protein, 7 aa, Brucella spp.
ALNPDVS

SEQ ID NO: 2267 - protein, 4 aa, Brucella spp.
RGAE

SEQ ID NO: 2268 - protein, 7 aa, Brucella spp.
TDTLRKH

SEQ ID NO: 2269 - protein, 24 aa, Brucella spp.
PGGAIDPEDGTTERAALREANEEI

SEQ ID NO: 2270 - protein, 6 aa, Brucella spp.
HPNPDE

SEQ ID NO: 2271 - protein, 6 aa, Brucella spp.
NHRRES

SEQ ID NO: 2272 - protein, 9 aa, Brucella spp.
NRDGGEARV

SEQ ID NO: 2273 - protein, 4 aa, Brucella spp.
HLPE

SEQ ID NO: 2274 - protein, 10 aa, Brucella spp.
AGFKPVPTGM

SEQ ID NO: 2275 - protein, 7 aa, Brucella spp.
IETNGRH

SEQ ID NO: 2276 - protein, 7 aa, Brucella spp.
ADAERRD

SEQ ID NO: 2277 - protein, 5 aa, Brucella spp.
EQRIR

SEQ ID NO: 2278 - protein, 17 aa, Brucella spp.
SGRPEAEGLRASARLKD

SEQ ID NO: 2279 - protein, 7 aa, Brucella spp.
GAPDPSR

SEQ ID NO: 2280 - protein, 4 aa, Brucella spp.
SDLG

SEQ ID NO: 2281 - protein, 7 aa, Brucella spp.
SNAERAR

SEQ ID NO: 2282 - protein, 10 aa, Brucella spp.
AVKPGLSEQA

SEQ ID NO: 2283 - protein, 6 aa, Brucella spp.
IYRGSK

SEQ ID NO: 2284 - protein, 10 aa, Brucella spp.
ARQEAVGSDE

SEQ ID NO: 2285 - protein, 10 aa, Brucella spp.
IEKGPGLGET

SEQ ID NO: 2286 - protein, 8 aa, Brucella spp.
RPDASTLA

SEQ ID NO: 2287 - protein, 6 aa, Brucella spp.
LAEGAS

SEQ ID NO: 2288 - protein, 43 aa, Brucella spp.
AKEVEESKTTALGDLKDPNARNANLPTDAEATDLARSAGEGKE

SEQ ID NO: 2289 - protein, 4 aa, Brucella spp.
ESGA

SEQ ID NO: 2290 - protein, 17 aa, Brucella spp.
STYDTAGRIRSGPAPEN

SEQ ID NO: 2291 - protein, 5 aa, Brucella spp.
YPTPR

SEQ ID NO: 2292 - protein, 5 aa, Brucella spp.
YKAPR

SEQ ID NO: 2293 - protein, 4 aa, Brucella spp.
DNPT

SEQ ID NO: 2294 - protein, 18 aa, Brucella spp.
GQTNPTGIEVKSKTDTLP

SEQ ID NO: 2295 - protein, 12 aa, Brucella spp.
NYIPADSLKTPA

SEQ ID NO: 2296 - protein, 7 aa, Brucella spp.
SRPAEGS

SEQ ID NO: 2297 - protein, 8 aa, Brucella spp.
PKRLPNSI

SEQ ID NO: 2298 - protein, 20 aa, Brucella spp.
AKGEGKAEIAPVEISAETKG

SEQ ID NO: 2299 - protein, 11 aa, Brucella spp.
AAEGANPAEPD

SEQ ID NO: 2300 - protein, 4 aa, Brucella spp.
KQES

SEQ ID NO: 2301 - protein, 12 aa, Brucella spp.
PFGTYDKGQLQR

SEQ ID NO: 2302 - protein, 7 aa, Brucella spp.
GYSPEQV

SEQ ID NO: 2303 - protein, 12 aa, Brucella spp.
EVEDGPNADGEM

SEQ ID NO: 2304 - protein, 22 aa, Brucella spp.
PAPYPNANAAAAANNGAAPPDL

SEQ ID NO: 2305 - protein, 6 aa, Brucella spp.
RSVERG

SEQ ID NO: 2306 - protein, 7 aa, Brucella spp.
AEGGPDY

SEQ ID NO: 2307 - protein, 8 aa, Brucella spp.
DEQPPAGM

SEQ ID NO: 2308 - protein, 4 aa, Brucella spp.
EGTH

SEQ ID NO: 2309 - protein, 21 aa, Brucella spp.
PLSDEQVTYEDGTPETVDQYA

SEQ ID NO: 2310 - protein, 9 aa, Brucella spp.
HLEDRKKTG

SEQ ID NO: 2311 - protein, 9 aa, Brucella spp.
IPDYPKPGV

SEQ ID NO: 2312 - protein, 8 aa, Brucella spp.
KGKLPRDT

SEQ ID NO: 2313 - protein, 5 aa, Brucella spp.
IEKGE

SEQ ID NO: 2314 - protein, 9 aa, Brucella spp.
ATGGTAEAA

SEQ ID NO: 2315 - protein, 6 aa, Brucella spp.
LGGRKK

SEQ ID NO: 2316 - protein, 9 aa, Brucella spp.
KTAAAQAAN

SEQ ID NO: 2317 - protein, 15 aa, Brucella spp.
PNTGEVAVPDPRQNE

SEQ ID NO: 2318 - protein, 10 aa, Brucella spp.
RGASKGEGLG

SEQ ID NO: 2319 - protein, 11 aa, Brucella spp.
IDPVSDAQTVE

SEQ ID NO: 2320 - protein, 10 aa, Brucella spp.
KRATGKDKEA

SEQ ID NO: 2321 - protein, 4 aa, Brucella spp.
SPED

SEQ ID NO: 2322 - protein, 10 aa, Brucella spp.
EGDATNGNAF

SEQ ID NO: 2323 - protein, 8 aa, Brucella spp.
MAEEQGAQ

SEQ ID NO: 2324 - protein, 10 aa, Brucella spp.
QLPDEEAGEY

SEQ ID NO: 2325 - protein, 5 aa, Brucella spp.
LEEPG

SEQ ID NO: 2326 - protein, 8 aa, Brucella spp.
AGPKETRA

SEQ ID NO: 2327 - protein, 9 aa, Brucella spp.
RGTKAPAAA

SEQ ID NO: 2328 - protein, 18 aa, Brucella spp.
NGELGAKEAGKARDEGKE

SEQ ID NO: 2329 - protein, 5 aa, Brucella spp.
PQYAH

SEQ ID NO: 2330 - protein, 5 aa, Brucella spp.
GQSIG

SEQ ID NO: 2331 - protein, 13 aa, Brucella spp.
IKTGGGSGGHNGI

SEQ ID NO: 2332 - protein, 8 aa, Brucella spp.
SFPGGQNY

SEQ ID NO: 2333 - protein, 5 aa, Brucella spp.
HPGAK

SEQ ID NO: 2334 - protein, 5 aa, Brucella spp.
KADNE

SEQ ID NO: 2335 - protein, 4 aa, Brucella spp.
EDNS

SEQ ID NO: 2336 - protein, 28 aa, Brucella spp.
GDGNQRPGGVKTDPAQLEKAPPKAQSHI

SEQ ID NO: 2337 - protein, 18 aa, Brucella spp.
RQARQNQKKPNIPESGPM

SEQ ID NO: 2338 - protein, 16 aa, Brucella spp.
TRVGKGSSRELRRNGQ

SEQ ID NO: 2339 - protein, 6 aa, Brucella spp.
DKQEPL

SEQ ID NO: 2340 - protein, 9 aa, Brucella spp.
EEAAPGIKR

SEQ ID NO: 2341 - protein, 11 aa, Brucella spp.
LPKGATPAIQD

SEQ ID NO: 2342 - protein, 22 aa, Brucella spp.
APAGLKSEENAEGAAEEAKDGE

SEQ ID NO: 2343 - protein, 14 aa, Brucella spp.
GGSASAAALGGGKQ

SEQ ID NO: 2344 - protein, 9 aa, Brucella spp.
GNSGSGKSH

SEQ ID NO: 2345 - protein, 7 aa, Brucella spp.
ARTEAEL

SEQ ID NO: 2346 - protein, 12 aa, Brucella spp.
AAAGEVSDEARK

SEQ ID NO: 2347 - protein, 5 aa, Brucella spp.
RKRGL

SEQ ID NO: 2348 - protein, 7 aa, Brucella spp.
KNVAAEA

SEQ ID NO: 2349 - protein, 5 aa, Brucella spp.
LSRRP

SEQ ID NO: 2350 - protein, 12 aa, Brucella spp.
VETSARSSSPKL

SEQ ID NO: 2351 - protein, 9 aa, Brucella spp.
LPDTPEDAR

SEQ ID NO: 2352 - protein, 6 aa, Brucella spp.
APEEIR

SEQ ID NO: 2353 - protein, 13 aa, Brucella spp.
RRTPPPPPPPSTA

SEQ ID NO: 2354 - protein, 11 aa, Brucella spp.
AKPKPEAEPVE

SEQ ID NO: 2355 - protein, 4 aa, Brucella spp.
EREE

SEQ ID NO: 2356 - protein, 7 aa, Brucella spp.
DDPEASF

SEQ ID NO: 2357 - protein, 13 aa, Brucella spp.
ASIESDVANGETW

SEQ ID NO: 2358 - protein, 6 aa, Brucella spp.
ESLTDD

SEQ ID NO: 2359 - protein, 10 aa, Brucella spp.
VTGAPCPSDA

SEQ ID NO: 2360 - protein, 21 aa, Brucella spp.
ETAPGDPNAPDDQADMGNAAE

SEQ ID NO: 2361 - protein, 4 aa, Brucella spp.
NVRG

SEQ ID NO: 2362 - protein, 7 aa, Brucella spp.
TSYPAND

SEQ ID NO: 2363 - protein, 6 aa, Brucella spp.
RSSARR

SEQ ID NO: 2364 - protein, 12 aa, Brucella spp.
QDRKPGPRTPIS

SEQ ID NO: 2365 - protein, 5 aa, Brucella spp.
EAGAS

SEQ ID NO: 2366 - protein, 5 aa, Brucella spp.
ANYAT

SEQ ID NO: 2367 - protein, 9 aa, Brucella spp.
RRERPGESE

SEQ ID NO: 2368 - protein, 6 aa, Brucella spp.
DSGGTL

SEQ ID NO: 2369 - protein, 8 aa, Brucella spp.
NKGANSVT

SEQ ID NO: 2370 - protein, 4 aa, Brucella spp.
IASS

SEQ ID NO: 2371 - protein, 11 aa, Brucella spp.
IQPTTAINDAP

SEQ ID NO: 2372 - protein, 13 aa, Brucella spp.
RTAAEESVSSLFD

SEQ ID NO: 2373 - protein, 9 aa, Brucella spp.
LRQARHTSN

SEQ ID NO: 2374 - protein, 8 aa, Brucella spp.
RDNANPAV

SEQ ID NO: 2375 - protein, 13 aa, Brucella spp.
GLTGANARKLDEQ

SEQ ID NO: 2376 - protein, 5 aa, Brucella spp.
PAEVA

SEQ ID NO: 2377 - protein, 10 aa, Brucella spp.
RAAELSDDAL

SEQ ID NO: 2378 - protein, 8 aa, Brucella spp.
TRAGASEA

SEQ ID NO: 2379 - protein, 9 aa, Brucella spp.
AGDGDYPAN

SEQ ID NO: 2380 - protein, 12 aa, Brucella spp.
SGRRKLNKNDQL

SEQ ID NO: 2381 - protein, 7 aa, Brucella spp.
MTPASTF

SEQ ID NO: 2382 - protein, 7 aa, Brucella spp.
NPESIQP

SEQ ID NO: 2383 - protein, 6 aa, Brucella spp.
DTQTAM

SEQ ID NO: 2384 - protein, 19 aa, Brucella spp.
TTNGAAQPLSRHSLDMIVK

SEQ ID NO: 2385 - protein, 8 aa, Brucella spp.
PVGQHGKR

SEQ ID NO: 2386 - protein, 8 aa, Brucella spp.
KGGVSDGI

SEQ ID NO: 2387 - protein, 19 aa, Brucella spp.
IGNGSNDAPEKIAENRRRV

SEQ ID NO: 2388 - protein, 10 aa, Brucella spp.
FGNPRPKADA

SEQ ID NO: 2389 - protein, 11 aa, Brucella spp.
PTIGPDNYEVG

SEQ ID NO: 2390 - protein, 5 aa, Brucella spp.
KDPNY

SEQ ID NO: 2391 - protein, 6 aa, Brucella spp.
PSEKPE

SEQ ID NO: 2392 - protein, 7 aa, Brucella spp.
KAGVQAD

SEQ ID NO: 2393 - protein, 21 aa, Brucella spp.
ATHRNEPDYGRQIAAIAIIED

SEQ ID NO: 2394 - protein, 5 aa, Brucella spp.
TTGPI

SEQ ID NO: 2395 - protein, 16 aa, Brucella spp.
DREAGYYTTREPFGRE

SEQ ID NO: 2396 - protein, 5 aa, Brucella spp.
PGRGT

SEQ ID NO: 2397 - protein, 16 aa, Brucella spp.
SPRLAEKQKQKLAGTK

SEQ ID NO: 2398 - protein, 4 aa, Brucella spp.
ADTV

SEQ ID NO: 2399 - protein, 6 aa, Brucella spp.
AGGIDP

SEQ ID NO: 2400 - protein, 6 aa, Brucella spp.
VKAEEG

SEQ ID NO: 2401 - protein, 5 aa, Brucella spp.
APART

SEQ ID NO: 2402 - protein, 6 aa, Brucella spp.
AATRGA

SEQ ID NO: 2403 - protein, 5 aa, Brucella spp.
SGFGD

SEQ ID NO: 2404 - protein, 12 aa, Brucella spp.
KACGCKTGTMTQ

SEQ ID NO: 2405 - protein, 13 aa, Brucella spp.
GRLGAGKDAAFQE

SEQ ID NO: 2406 - protein, 6 aa, Brucella spp.
AAPDQM

SEQ ID NO: 2407 - protein, 8 aa, Brucella spp.
NQPPMAPE

SEQ ID NO: 2408 - protein, 10 aa, Brucella spp.
NGGPLPRHPS

SEQ ID NO: 2409 - protein, 5 aa, Brucella spp.
LKQPG

SEQ ID NO: 2410 - protein, 12 aa, Brucella spp.
DAAGAAQGVRRE

SEQ ID NO: 2411 - protein, 8 aa, Brucella spp.
ALRSQGER

SEQ ID NO: 2412 - protein, 7 aa, Brucella spp.
ARSEKSA

SEQ ID NO: 2413 - protein, 23 aa, Brucella spp.
FEGGSSAKPAKSASVSSKSKDNS

SEQ ID NO: 2414 - protein, 8 aa, Brucella spp.
PEARKPAY

SEQ ID NO: 2415 - protein, 10 aa, Brucella spp.
IKKSSAQITR

SEQ ID NO: 2416 - protein, 7 aa, Brucella spp.
MPDEDGE

SEQ ID NO: 2417 - protein, 8 aa, Brucella spp.
YPQEPGYD

SEQ ID NO: 2418 - protein, 11 aa, Brucella spp.
PDPLPPPGPKP

SEQ ID NO: 2419 - protein, 8 aa, Brucella spp.
SQAYASNT

SEQ ID NO: 2420 - protein, 14 aa, Brucella spp.
AAESFGKGRPMPEG

SEQ ID NO: 2421 - protein, 10 aa, Brucella spp.
HPRGAEEVRR

SEQ ID NO: 2422 - protein, 8 aa, Brucella spp.
IDTEPLNQ

SEQ ID NO: 2423 - protein, 10 aa, Brucella spp.
RGEGAEETAT

SEQ ID NO: 2424 - protein, 8 aa, Brucella spp.
ESEARLRE

SEQ ID NO: 2425 - protein, 5 aa, Brucella spp.
EGDRE

SEQ ID NO: 2426 - protein, 12 aa, Brucella spp.
DDGPGMPENRRE

SEQ ID NO: 2427 - protein, 13 aa, Brucella spp.
EARTQDSGGTGGL

SEQ ID NO: 2428 - protein, 7 aa, Brucella spp.
ARSHGGD

SEQ ID NO: 2429 - protein, 16 aa, Brucella spp.
EDSPLGGLRATIHIPA

SEQ ID NO: 2430 - protein, 8 aa, Brucella spp.
EKTLSDDA

SEQ ID NO: 2431 - protein, 4 aa, Brucella spp.
DTRI

SEQ ID NO: 2432 - protein, 10 aa, Brucella spp.
GSAAEARRKL

SEQ ID NO: 2433 - protein, 5 aa, Brucella spp.
ETGVS

SEQ ID NO: 2434 - protein, 7 aa, Brucella spp.
SLREQKN

SEQ ID NO: 2435 - protein, 17 aa, Brucella spp.
SETDSRIDGLAAGADDY

SEQ ID NO: 2436 - protein, 7 aa, Brucella spp.
PKPFDPR

SEQ ID NO: 2437 - protein, 10 aa, Brucella spp.
RGAPPAQPKI

SEQ ID NO: 2438 - protein, 9 aa, Brucella spp.
LKKGTETIK

SEQ ID NO: 2439 - protein, 5 aa, Brucella spp.
TDREQ

SEQ ID NO: 2440 - protein, 7 aa, Brucella spp.
AGETIPR

SEQ ID NO: 2441 - protein, 12 aa, Brucella spp.
LTGQDGDVGERT

SEQ ID NO: 2442 - protein, 8 aa, Brucella spp.
IEQDPANP

SEQ ID NO: 2443 - protein, 10 aa, Brucella spp.
STDVNSTSDM

SEQ ID NO: 2444 - protein, 8 aa, Brucella spp.
LTAEEATD

SEQ ID NO: 2445 - protein, 4 aa, Brucella spp.
PGMT

SEQ ID NO: 2446 - protein, 8 aa, Brucella spp.
ATGQHDRR

SEQ ID NO: 2447 - protein, 8 aa, Brucella spp.
YPTKSGRQ

SEQ ID NO: 2448 - protein, 6 aa, Brucella spp.
CAQQDR

SEQ ID NO: 2449 - protein, 6 aa, Brucella spp.
PERRAQ

SEQ ID NO: 2450 - protein, 14 aa, Brucella spp.
AADRVDTKTHPCRQ

SEQ ID NO: 2451 - protein, 24 aa, Brucella spp.
SRNKADGFGEAPQAGFSGAPLSGT

SEQ ID NO: 2452 - protein, 53 aa, Brucella spp.
EIGDEAAKPRAKNPKQPKKIPERSKEASRTGRGTSMGGAASAKERTAAGLNPV

SEQ ID NO: 2453 - protein, 13 aa, Brucella spp.
AAGLSPSGATATV

SEQ ID NO: 2454 - protein, 4 aa, Brucella spp.
SGNP

SEQ ID NO: 2455 - protein, 14 aa, Brucella spp.
HRPARPEKSEGGIP

SEQ ID NO: 2456 - protein, 11 aa, Brucella spp.
FEPSGDQPTAI

SEQ ID NO: 2457 - protein, 7 aa, Brucella spp.
LENQDRT

SEQ ID NO: 2458 - protein, 7 aa, Brucella spp.
TGSGKTF

SEQ ID NO: 2459 - protein, 5 aa, Brucella spp.
KTQRP

SEQ ID NO: 2460 - protein, 18 aa, Brucella spp.
YVPRSDTYIEKESSINEQ

SEQ ID NO: 2461 - protein, 4 aa, Brucella spp.
QYKR

SEQ ID NO: 2462 - protein, 11 aa, Brucella spp.
PLTGQKTGDLK

SEQ ID NO: 2463 - protein, 8 aa, Brucella spp.
VTPRPTLN

SEQ ID NO: 2464 - protein, 4 aa, Brucella spp.
DQRT

SEQ ID NO: 2465 - protein, 6 aa, Brucella spp.
GSCAGI

SEQ ID NO: 2466 - protein, 11 aa, Brucella spp.
TGRKPGEPPPT

SEQ ID NO: 2467 - protein, 7 aa, Brucella spp.
SATPGNW

SEQ ID NO: 2468 - protein, 8 aa, Brucella spp.
RPAKTQVD

SEQ ID NO: 2469 - protein, 10 aa, Brucella spp.
IRDTAKKGYR

SEQ ID NO: 2470 - protein, 6 aa, Brucella spp.
KEGFLR

SEQ ID NO: 2471 - protein, 6 aa, Brucella spp.
AARNVD

SEQ ID NO: 2472 - protein, 4 aa, Brucella spp.
TGSM

SEQ ID NO: 2473 - protein, 17 aa, Brucella spp.
IDETNRRREKQQAYNEA

SEQ ID NO: 2474 - protein, 11 aa, Brucella spp.
GITPASVKKNI

SEQ ID NO: 2475 - protein, 5 aa, Brucella spp.
GFAEE

SEQ ID NO: 2476 - protein, 4 aa, Brucella spp.
RDAA

SEQ ID NO: 2477 - protein, 16 aa, Brucella spp.
ESPVTGRTKGRHNAGR

SEQ ID NO: 2478 - protein, 10 aa, Brucella spp.
TDDEGGKSLF

SEQ ID NO: 2479 - protein, 29 aa, Brucella spp.
LDNMGPGTDMAKPRHDGPLPTAAESRFRK

SEQ ID NO: 2480 - protein, 42 aa, Brucella spp.
TEIPAGGKAPIRRERAGIGSYEDPAEVSRKKRRPGKTGRPGR

SEQ ID NO: 2481 - protein, 9 aa, Brucella spp.
MPKDANSAY

SEQ ID NO: 2482 - protein, 12 aa, Brucella spp.
RSAERARGRTVT

SEQ ID NO: 2483 - protein, 12 aa, Brucella spp.
ADGKPTPAPQED

SEQ ID NO: 2484 - protein, 17 aa, Brucella spp.
SGERAPRPQADVGNADR

SEQ ID NO: 2485 - protein, 20 aa, Brucella spp.
PSAPVADAPVASALPQPQEE

SEQ ID NO: 2486 - protein, 7 aa, Brucella spp.
EEEENHV

SEQ ID NO: 2487 - protein, 14 aa, Brucella spp.
QSMPRSQPQYSGDY

SEQ ID NO: 2488 - protein, 10 aa, Brucella spp.
SAPIGNPVTA

SEQ ID NO: 2489 - protein, 5 aa, Brucella spp.
ATACR

SEQ ID NO: 2490 - protein, 7 aa, Brucella spp.
KPPIYRS

SEQ ID NO: 2491 - protein, 6 aa, Brucella spp.
GFNSGS

SEQ ID NO: 2492 - protein, 5 aa, Brucella spp.
LQPAA

SEQ ID NO: 2493 - protein, 15 aa, Brucella spp.
RRGAKMSEHSRGNAI

SEQ ID NO: 2494 - protein, 7 aa, Brucella spp.
PGYNPEH

SEQ ID NO: 2495 - protein, 7 aa, Brucella spp.
QQSERPR

SEQ ID NO: 2496 - protein, 27 aa, Brucella spp.
ARAHGDLSENAEYHAAKEAQSLNEGRI

SEQ ID NO: 2497 - protein, 5 aa, Brucella spp.
LTGDR

SEQ ID NO: 2498 - protein, 7 aa, Brucella spp.
EDTEEEK

SEQ ID NO: 2499 - protein, 11 aa, Brucella spp.
DQEADVKEGRI

SEQ ID NO: 2500 - protein, 27 aa, Brucella spp.
GKGEGDTIEVNAPGGSRSYEIIALKFV

SEQ ID NO: 2501 - protein, 10 aa, Brucella spp.
LDGSTRTPEY

SEQ ID NO: 2502 - protein, 8 aa, Brucella spp.
ARNPNGKV

SEQ ID NO: 2503 - protein, 12 aa, Brucella spp.
PERAGDATPERL

SEQ ID NO: 2504 - protein, 7 aa, Brucella spp.
LAGGEKA

SEQ ID NO: 2505 - protein, 28 aa, Brucella spp.
QGTQKSRRRKAKRGLGERLRKSSSRLLG

SEQ ID NO: 2506 - protein, 9 aa, Brucella spp.
GGAVPDGTD

SEQ ID NO: 2507 - protein, 14 aa, Brucella spp.
GEIGINPDQRLQED

SEQ ID NO: 2508 - protein, 6 aa, Brucella spp.
RYAREA

SEQ ID NO: 2509 - protein, 10 aa, Brucella spp.
SRGEGDERRR

SEQ ID NO: 2510 - protein, 7 aa, Brucella spp.
GGTETQR

SEQ ID NO: 2511 - protein, 6 aa, Brucella spp.
YFPPGN

SEQ ID NO: 2512 - protein, 4 aa, Brucella spp.
STEE

SEQ ID NO: 2513 - protein, 8 aa, Brucella spp.
DGLDTEAY

SEQ ID NO: 2514 - protein, 18 aa, Brucella spp.
LEDDPSGKPLELPALKTA

SEQ ID NO: 2515 - protein, 7 aa, Brucella spp.
YSGTQAC

SEQ ID NO: 2516 - protein, 4 aa, Brucella spp.
LKEE

SEQ ID NO: 2517 - protein, 5 aa, Brucella spp.
NPATI

SEQ ID NO: 2518 - protein, 6 aa, Brucella spp.
KERPDA

SEQ ID NO: 2519 - protein, 8 aa, Brucella spp.
MGGQTALN

SEQ ID NO: 2520 - protein, 10 aa, Brucella spp.
AEAIDKAEDR

SEQ ID NO: 2521 - protein, 7 aa, Brucella spp.
GLDTPGS

SEQ ID NO: 2522 - protein, 16 aa, Brucella spp.
TEIKDEDRKRHEVKRA

SEQ ID NO: 2523 - protein, 11 aa, Brucella spp.
KAQFSGDELDK

SEQ ID NO: 2524 - protein, 5 aa, Brucella spp.
ERKQR

SEQ ID NO: 2525 - protein, 9 aa, Brucella spp.
LGGTGGGIA

SEQ ID NO: 2526 - protein, 8 aa, Brucella spp.
LDASPTTE

SEQ ID NO: 2527 - protein, 7 aa, Brucella spp.
VETGGSN

SEQ ID NO: 2528 - protein, 16 aa, Brucella spp.
RVSRSSALASKATGFP

SEQ ID NO: 2529 - protein, 14 aa, Brucella spp.
NDITGGATPASFEP

SEQ ID NO: 2530 - protein, 6 aa, Brucella spp.
PGSSPI

SEQ ID NO: 2531 - protein, 10 aa, Brucella spp.
IEEGDEKNAI

SEQ ID NO: 2532 - protein, 8 aa, Brucella spp.
IGTPTPDR

SEQ ID NO: 2533 - protein, 5 aa, Brucella spp.
TEERI

SEQ ID NO: 2534 - protein, 7 aa, Brucella spp.
GLPQDAE

SEQ ID NO: 2535 - protein, 11 aa, Brucella spp.
SLTAKDAEDVA

SEQ ID NO: 2536 - protein, 12 aa, Brucella spp.
GQPRSEAEVSDR

SEQ ID NO: 2537 - protein, 8 aa, Brucella spp.
GGPNRIGQ

SEQ ID NO: 2538 - protein, 12 aa, Brucella spp.
PETVSTDYDTSD

SEQ ID NO: 2539 - protein, 6 aa, Brucella spp.
KQKGTL

SEQ ID NO: 2540 - protein, 5 aa, Brucella spp.
GQTPL

SEQ ID NO: 2541 - protein, 7 aa, Brucella spp.
GTSPDAI

SEQ ID NO: 2542 - protein, 5 aa, Brucella spp.
EDRDR

SEQ ID NO: 2543 - protein, 7 aa, Brucella spp.
NQPKNGI

SEQ ID NO: 2544 - protein, 12 aa, Brucella spp.
AKYPNDKTGQIN

SEQ ID NO: 2545 - protein, 6 aa, Brucella spp.
GIHSGD

SEQ ID NO: 2546 - protein, 5 aa, Brucella spp.
RQTAA

SEQ ID NO: 2547 - protein, 6 aa, Brucella spp.
PRASRT

SEQ ID NO: 2548 - protein, 5 aa, Brucella spp.
VGTPI

SEQ ID NO: 2549 - protein, 12 aa, Brucella spp.
AYGGKPQPTARP

SEQ ID NO: 2550 - protein, 7 aa, Brucella spp.
EMRSTGE

SEQ ID NO: 2551 - protein, 5 aa, Brucella spp.
ELPRE

SEQ ID NO: 2552 - protein, 8 aa, Brucella spp.
DEDKERVL

SEQ ID NO: 2553 - protein, 6 aa, Brucella spp.
TGGTQK

SEQ ID NO: 2554 - protein, 7 aa, Brucella spp.
NGVESTK

SEQ ID NO: 2555 - protein, 4 aa, Brucella spp.
GRPH

SEQ ID NO: 2556 - protein, 15 aa, Brucella spp.
TDSASAVSDSKSIRR

SEQ ID NO: 2557 - protein, 8 aa, Brucella spp.
GAESAAEA

SEQ ID NO: 2558 - protein, 12 aa, Brucella spp.
IEGKGLGATGAV

SEQ ID NO: 2559 - protein, 6 aa, Brucella spp.
DPSYAG

SEQ ID NO: 2560 - protein, 18 aa, Brucella spp.
GANAEDIEDLTPANRHGA

SEQ ID NO: 2561 - protein, 9 aa, Brucella spp.
TAPSNFRAA

SEQ ID NO: 2562 - protein, 6 aa, Brucella spp.
ERGAQN

SEQ ID NO: 2563 - protein, 7 aa, Brucella spp.
HDPNGNF

SEQ ID NO: 2564 - protein, 10 aa, Brucella spp.
DGYGEQDAPQ

SEQ ID NO: 2565 - protein, 6 aa, Brucella spp.
ATATAE

SEQ ID NO: 2566 - protein, 13 aa, Brucella spp.
NGPGDPAATGEYA

SEQ ID NO: 2567 - protein, 25 aa, Brucella spp.
GGRTEKMHQGHHGANHPVKDYTTGK

SEQ ID NO: 2568 - protein, 10 aa, Brucella spp.
SDSLPENVEE

SEQ ID NO: 2569 - protein, 10 aa, Brucella spp.
PEASPGPQDS

SEQ ID NO: 2570 - protein, 14 aa, Brucella spp.
RKGQAPLPEREQAA

SEQ ID NO: 2571 - protein, 8 aa, Brucella spp.
KAQEKRRM

SEQ ID NO: 2572 - protein, 17 aa, Brucella spp.
DRDIANRTAGKDPVGDE

SEQ ID NO: 2573 - protein, 14 aa, Brucella spp.
KQREESARIYEEGS

SEQ ID NO: 2574 - protein, 5 aa, Brucella spp.
EAERE

SEQ ID NO: 2575 - protein, 10 aa, Brucella spp.
MTEDETKKAC

SEQ ID NO: 2576 - protein, 4 aa, Brucella spp.
QGLR

SEQ ID NO: 2577 - protein, 11 aa, Brucella spp.
DRKKSNPPKGD

SEQ ID NO: 2578 - protein, 6 aa, Brucella spp.
EKTPSF

SEQ ID NO: 2579 - protein, 17 aa, Brucella spp.
PMPARDPEMEKREAQRA

SEQ ID NO: 2580 - protein, 10 aa, Brucella spp.
QSATGAKARA

SEQ ID NO: 2581 - protein, 8 aa, Brucella spp.
GLSTATQQ

SEQ ID NO: 2582 - protein, 7 aa, Brucella spp.
APESRNA

SEQ ID NO: 2583 - protein, 8 aa, Brucella spp.
KGVSREQI

SEQ ID NO: 2584 - protein, 17 aa, Brucella spp.
ALSADAPAKYLNSPETE

SEQ ID NO: 2585 - protein, 13 aa, Brucella spp.
KACQPQGGEPAKP

SEQ ID NO: 2586 - protein, 4 aa, Brucella spp.
ALTE

SEQ ID NO: 2587 - protein, 6 aa, Brucella spp.
DGAGLR

SEQ ID NO: 2588 - protein, 9 aa, Brucella spp.
EGQDPDDLV

SEQ ID NO: 2589 - protein, 7 aa, Brucella spp.
KAEGPSA

SEQ ID NO: 2590 - protein, 16 aa, Brucella spp.
ETAGGVFDTPERRAEL

SEQ ID NO: 2591 - protein, 5 aa, Brucella spp.
QDMRE

SEQ ID NO: 2592 - protein, 33 aa, Brucella spp.
RQGFQNGGQRSQSFTRRNEGARGRGGPAGSGRL

SEQ ID NO: 2593 - protein, 4 aa, Brucella spp.
LARS

SEQ ID NO: 2594 - protein, 14 aa, Brucella spp.
KGGRQGGAAHAPLR

SEQ ID NO: 2595 - protein, 4 aa, Brucella spp.
RVDD

SEQ ID NO: 2596 - protein, 10 aa, Brucella spp.
AAEDDAREAL

SEQ ID NO: 2597 - protein, 8 aa, Brucella spp.
LETDETGE

SEQ ID NO: 2598 - protein, 5 aa, Brucella spp.
DATEA

SEQ ID NO: 2599 - protein, 12 aa, Brucella spp.
EVEREGAADGPL

SEQ ID NO: 2600 - protein, 4 aa, Brucella spp.
RGYV

SEQ ID NO: 2601 - protein, 11 aa, Brucella spp.
PSEEVTSEQIE

SEQ ID NO: 2602 - protein, 47 aa, Brucella spp.
EDDEQDNDREEGNDDEAEEGGDLVEAGGTAVATTTTKKEPTDRTDDP

SEQ ID NO: 2603 - protein, 5 aa, Brucella spp.
EAGRE

SEQ ID NO: 2604 - protein, 12 aa, Brucella spp.
TYAGPEAKQAPV

SEQ ID NO: 2605 - protein, 40 aa, Brucella spp.
EEEKPRDERPQRRSRDDDDITNVGGDMPVEDDDDDEDEAN

SEQ ID NO: 2606 - protein, 9 aa, Brucella spp.
LQDQQVEGR

SEQ ID NO: 2607 - protein, 17 aa, Brucella spp.
LAATGELSSSQERRYKE

SEQ ID NO: 2608 - protein, 5 aa, Brucella spp.
LPSRG

SEQ ID NO: 2609 - protein, 9 aa, Brucella spp.
AKEADSIGR

SEQ ID NO: 2610 - protein, 11 aa, Brucella spp.
VQKGEREATIA

SEQ ID NO: 2611 - protein, 6 aa, Brucella spp.
KYTNRG

SEQ ID NO: 2612 - protein, 8 aa, Brucella spp.
SIADQART

SEQ ID NO: 2613 - protein, 8 aa, Brucella spp.
REPTPEEL

SEQ ID NO: 2614 - protein, 5 aa, Brucella spp.
PISLE

SEQ ID NO: 2615 - protein, 10 aa, Brucella spp.
TPVGDEEDSH

SEQ ID NO: 2616 - protein, 6 aa, Brucella spp.
LRDTTT

SEQ ID NO: 2617 - protein, 6 aa, Brucella spp.
LTPREE

SEQ ID NO: 2618 - protein, 15 aa, Brucella spp.
KHPSRSRKLRSFLDS

SEQ ID NO: 2619 - protein, 16 aa, Brucella spp.
SASETPAEPKEAGRLE

SEQ ID NO: 2620 - protein, 8 aa, Brucella spp.
PYSEGGQY

SEQ ID NO: 2621 - protein, 6 aa, Brucella spp.
TIDGEV

SEQ ID NO: 2622 - protein, 5 aa, Brucella spp.
CPGIE

SEQ ID NO: 2623 - protein, 9 aa, Brucella spp.
SASANAASA

SEQ ID NO: 2624 - protein, 4 aa, Brucella spp.
GAKM

SEQ ID NO: 2625 - protein, 5 aa, Brucella spp.
TYRGR

SEQ ID NO: 2626 - protein, 7 aa, Brucella spp.
HGRPTSV

SEQ ID NO: 2627 - protein, 9 aa, Brucella spp.
ENQMTTQPA

SEQ ID NO: 2628 - protein, 15 aa, Brucella spp.
AKTAREAMTANNEAM

SEQ ID NO: 2629 - protein, 12 aa, Brucella spp.
AGIEDRDLQTGG

SEQ ID NO: 2630 - protein, 13 aa, Brucella spp.
DDKNNLKEPTITG

SEQ ID NO: 2631 - protein, 6 aa, Brucella spp.
VNQGGD

SEQ ID NO: 2632 - protein, 8 aa, Brucella spp.
NDNPSAVI

SEQ ID NO: 2633 - protein, 7 aa, Brucella spp.
ARKRAVA

SEQ ID NO: 2634 - protein, 11 aa, Brucella spp.
AKTLADAAGVG

SEQ ID NO: 2635 - protein, 6 aa, Brucella spp.
SRPPMP

SEQ ID NO: 2636 - protein, 26 aa, Brucella spp.
APDNSVPIAAGENSYNVSVNVVFEIK

SEQ ID NO: 2637 - protein, 9 aa, Brucella spp.
GTKTPSETI

SEQ ID NO: 2638 - protein, 16 aa, Brucella spp.
ERDDAAEEVTVTTSDG

SEQ ID NO: 2639 - protein, 5 aa, Brucella spp.
ASING

SEQ ID NO: 2640 - protein, 8 aa, Brucella spp.
TKGLSGDK

SEQ ID NO: 2641 - protein, 6 aa, Brucella spp.
ERYDEE

SEQ ID NO: 2642 - protein, 9 aa, Brucella spp.
VQGQSASDC

SEQ ID NO: 2643 - protein, 19 aa, Brucella spp.
PKAQYPGKTGILRSGPASA

SEQ ID NO: 2644 - protein, 4 aa, Brucella spp.
LWKS

SEQ ID NO: 2645 - protein, 5 aa, Brucella spp.
TSDGG

SEQ ID NO: 2646 - protein, 19 aa, Brucella spp.
TASGPDGAAGKKWKGKYAT

SEQ ID NO: 2647 - protein, 8 aa, Brucella spp.
GMNEKGLA

SEQ ID NO: 2648 - protein, 15 aa, Brucella spp.
KYQDPSTAKPEDSLA

SEQ ID NO: 2649 - protein, 7 aa, Brucella spp.
DLGFTPP

SEQ ID NO: 2650 - protein, 4 aa, Brucella spp.
ATGA

SEQ ID NO: 2651 - protein, 4 aa, Brucella spp.
TNSP

SEQ ID NO: 2652 - protein, 7 aa, Brucella spp.
RENPKPL

SEQ ID NO: 2653 - protein, 5 aa, Brucella spp.
SFGQG

SEQ ID NO: 2654 - protein, 12 aa, Brucella spp.
GIPGDTTPPSRF

SEQ ID NO: 2655 - protein, 8 aa, Brucella spp.
KKVPSGLE

SEQ ID NO: 2656 - protein, 7 aa, Brucella spp.
KGWSEEQ

SEQ ID NO: 2657 - protein, 13 aa, Brucella spp.
KSLTDSRLSQPER

SEQ ID NO: 2658 - protein, 13 aa, Brucella spp.
DNKNGAAKEADDL

SEQ ID NO: 2659 - protein, 5 aa, Brucella spp.
ATQEQ

SEQ ID NO: 2660 - protein, 17 aa, Brucella spp.
ANHSSFASNHSGSRPFD

SEQ ID NO: 2661 - protein, 8 aa, Brucella spp.
QNSEGAEF

SEQ ID NO: 2662 - protein, 6 aa, Brucella spp.
CTPTGL

SEQ ID NO: 2663 - protein, 4 aa, Brucella spp.
EEAP

SEQ ID NO: 2664 - protein, 4 aa, Brucella spp.
TTED

SEQ ID NO: 2665 - protein, 5 aa, Brucella spp.
ADGLG

SEQ ID NO: 2666 - protein, 9 aa, Brucella spp.
LSSTPSRPY

SEQ ID NO: 2667 - protein, 7 aa, Brucella spp.
AYGPNGD

SEQ ID NO: 2668 - protein, 6 aa, Brucella spp.
ANHPGD

SEQ ID NO: 2669 - protein, 4 aa, Brucella spp.
SGIT

SEQ ID NO: 2670 - protein, 8 aa, Brucella spp.
ESFQPASE

SEQ ID NO: 2671 - protein, 21 aa, Brucella spp.
PVPSPLPETGNTAAPSMPPAV

SEQ ID NO: 2672 - protein, 6 aa, Brucella spp.
VECTEN

SEQ ID NO: 2673 - protein, 5 aa, Brucella spp.
NGGLK

SEQ ID NO: 2674 - protein, 17 aa, Brucella spp.
SGETEMNHNGGIRDDEI

SEQ ID NO: 2675 - protein, 6 aa, Brucella spp.
RDPNFS

SEQ ID NO: 2676 - protein, 4 aa, Brucella spp.
TDPD

SEQ ID NO: 2677 - protein, 6 aa, Brucella spp.
LPKTGS

SEQ ID NO: 2678 - protein, 4 aa, Brucella spp.
QGGI

SEQ ID NO: 2679 - protein, 8 aa, Brucella spp.
SAEKGTAA

SEQ ID NO: 2680 - protein, 10 aa, Brucella spp.
GPDFKPADYG

SEQ ID NO: 2681 - protein, 11 aa, Brucella spp.
YPEAPTATGVQ

SEQ ID NO: 2682 - protein, 6 aa, Brucella spp.
SEDGRY

SEQ ID NO: 2683 - protein, 23 aa, Brucella spp.
YTMSGKAAVKKSLSDKVAGSTNI

SEQ ID NO: 2684 - protein, 8 aa, Brucella spp.
NDQDRKIV

SEQ ID NO: 2685 - protein, 12 aa, Brucella spp.
PAYQPGPYSVEH

SEQ ID NO: 2686 - protein, 14 aa, Brucella spp.
PRLRGEAAKLSRVA

SEQ ID NO: 2687 - protein, 4 aa, Brucella spp.
SARY

SEQ ID NO: 2688 - protein, 15 aa, Brucella spp.
RGHGANITSHAPKGM

SEQ ID NO: 2689 - protein, 5 aa, Brucella spp.
APKQG

SEQ ID NO: 2690 - protein, 9 aa, Brucella spp.
FDGGAQSAA

SEQ ID NO: 2691 - protein, 7 aa, Brucella spp.
GSDVPSG

SEQ ID NO: 2692 - protein, 5 aa, Brucella spp.
DPAEV

SEQ ID NO: 2693 - protein, 6 aa, Brucella spp.
ANNRNF

SEQ ID NO: 2694 - protein, 11 aa, Brucella spp.
AEDPATAGGAA

SEQ ID NO: 2695 - protein, 5 aa, Brucella spp.
RHESL

SEQ ID NO: 2696 - protein, 10 aa, Brucella spp.
SGFDTSPDMI

SEQ ID NO: 2697 - protein, 8 aa, Brucella spp.
SFEPDAET

SEQ ID NO: 2698 - protein, 7 aa, Brucella spp.
DNMGEQT

SEQ ID NO: 2699 - protein, 10 aa, Brucella spp.
TKGRAALPPV

SEQ ID NO: 2700 - protein, 7 aa, Brucella spp.
DEQEQAD

SEQ ID NO: 2701 - protein, 14 aa, Brucella spp.
GEVEAPHDAHDTRR

SEQ ID NO: 2702 - protein, 4 aa, Brucella spp.
ASGN

SEQ ID NO: 2703 - protein, 8 aa, Brucella spp.
AEDQTSQL

SEQ ID NO: 2704 - protein, 10 aa, Brucella spp.
VGGEYGTTAT

SEQ ID NO: 2705 - protein, 17 aa, Brucella spp.
HETSTEKTRGNKAAGSF

SEQ ID NO: 2706 - protein, 11 aa, Brucella spp.
AGMSKETASET

SEQ ID NO: 2707 - protein, 5 aa, Brucella spp.
DKVGR

SEQ ID NO: 2708 - protein, 4 aa, Brucella spp.
VQSS

SEQ ID NO: 2709 - protein, 18 aa, Brucella spp.
DRTKGTRMSAGTTRQKAI

SEQ ID NO: 2710 - protein, 9 aa, Brucella spp.
PYSDSEPIR

SEQ ID NO: 2711 - protein, 6 aa, Brucella spp.
TLPPST

SEQ ID NO: 2712 - protein, 10 aa, Brucella spp.
LRDDGYDKDS

SEQ ID NO: 2713 - protein, 5 aa, Brucella spp.
AEPSR

SEQ ID NO: 2714 - protein, 6 aa, Brucella spp.
SQPRVS

SEQ ID NO: 2715 - protein, 6 aa, Brucella spp.
AISGEV

SEQ ID NO: 2716 - protein, 10 aa, Brucella spp.
VKSSRQEKAA

SEQ ID NO: 2717 - protein, 7 aa, Brucella spp.
ANAGSWD

SEQ ID NO: 2718 - protein, 5 aa, Brucella spp.
TAVET

SEQ ID NO: 2719 - protein, 7 aa, Brucella spp.
AVGEKPF

SEQ ID NO: 2720 - protein, 5 aa, Brucella spp.
GTGTG

SEQ ID NO: 2721 - protein, 6 aa, Brucella spp.
AQVRQG

SEQ ID NO: 2722 - protein, 6 aa, Brucella spp.
RALRPN

SEQ ID NO: 2723 - protein, 7 aa, Brucella spp.
GLEPEKT

SEQ ID NO: 2724 - protein, 13 aa, Brucella spp.
ELEPKAANGEEGL

SEQ ID NO: 2725 - protein, 13 aa, Brucella spp.
VSHGSQKWQPVLG

SEQ ID NO: 2726 - protein, 11 aa, Brucella spp.
GAGGSTRERTV

SEQ ID NO: 2727 - protein, 5 aa, Brucella spp.
DIKPA

SEQ ID NO: 2728 - protein, 6 aa, Brucella spp.
TREDVD

SEQ ID NO: 2729 - protein, 9 aa, Brucella spp.
GDPANGIGE

SEQ ID NO: 2730 - protein, 12 aa, Brucella spp.
YVPTPGGYQNGA

SEQ ID NO: 2731 - protein, 13 aa, Brucella spp.
AYPEKHPESPDFA

SEQ ID NO: 2732 - protein, 7 aa, Brucella spp.
VDNGATR

SEQ ID NO: 2733 - protein, 8 aa, Brucella spp.
LDNDPQTH

SEQ ID NO: 2734 - protein, 6 aa, Brucella spp.
RSGSKF

SEQ ID NO: 2735 - protein, 9 aa, Brucella spp.
TSLAGGSRF

SEQ ID NO: 2736 - protein, 5 aa, Brucella spp.
TGRDL

SEQ ID NO: 2737 - protein, 6 aa, Brucella spp.
APTTEI

SEQ ID NO: 2738 - protein, 13 aa, Brucella spp.
RDYGHTTAEKREA

SEQ ID NO: 2739 - protein, 9 aa, Brucella spp.
ATGHTGVED

SEQ ID NO: 2740 - protein, 5 aa, Brucella spp.
SQGTT

SEQ ID NO: 2741 - protein, 7 aa, Brucella spp.
KKKMGSL

SEQ ID NO: 2742 - protein, 6 aa, Brucella spp.
AEGAEV

SEQ ID NO: 2743 - protein, 6 aa, Brucella spp.
KPAPGA

SEQ ID NO: 2744 - protein, 6 aa, Brucella spp.
FGAGGY

SEQ ID NO: 2745 - protein, 10 aa, Brucella spp.
RDPTAIEAGR

SEQ ID NO: 2746 - protein, 4 aa, Brucella spp.
KEFP

SEQ ID NO: 2747 - protein, 10 aa, Brucella spp.
RMSGAGKKVD

SEQ ID NO: 2748 - protein, 7 aa, Brucella spp.
DEAERGF

SEQ ID NO: 2749 - protein, 5 aa, Brucella spp.
KDGPL

SEQ ID NO: 2750 - protein, 11 aa, Brucella spp.
SSRGPSAADAV

SEQ ID NO: 2751 - protein, 6 aa, Brucella spp.
RLKTGD

SEQ ID NO: 2752 - protein, 5 aa, Brucella spp.
ERHAG

SEQ ID NO: 2753 - protein, 8 aa, Brucella spp.
RAAKPFTR

SEQ ID NO: 2754 - protein, 10 aa, Brucella spp.
GRNPKDRIHP

SEQ ID NO: 2755 - protein, 12 aa, Brucella spp.
RAGGSAGSRHMP

SEQ ID NO: 2756 - protein, 20 aa, Brucella spp.
GAVGPTPEEEERNPRARSAK

SEQ ID NO: 2757 - protein, 11 aa, Brucella spp.
GIRTENPPLED

SEQ ID NO: 2758 - protein, 9 aa, Brucella spp.
RQIDSEKDT

SEQ ID NO: 2759 - protein, 4 aa, Brucella spp.
QPGR

SEQ ID NO: 2760 - protein, 6 aa, Brucella spp.
IPERPV

SEQ ID NO: 2761 - protein, 5 aa, Brucella spp.
SGSDE

SEQ ID NO: 2762 - protein, 18 aa, Brucella spp.
AITTGSVRKSGARRGPCG

SEQ ID NO: 2763 - protein, 7 aa, Brucella spp.
APDGSIH

SEQ ID NO: 2764 - protein, 11 aa, Brucella spp.
GEVPAGDEKLA

SEQ ID NO: 2765 - protein, 9 aa, Brucella spp.
RKRHGNRAR

SEQ ID NO: 2766 - protein, 8 aa, Brucella spp.
VDQDAAGP

SEQ ID NO: 2767 - protein, 5 aa, Brucella spp.
RPDIL

SEQ ID NO: 2768 - protein, 4 aa, Brucella spp.
LYAE

SEQ ID NO: 2769 - protein, 6 aa, Brucella spp.
VDPDET

SEQ ID NO: 2770 - protein, 5 aa, Brucella spp.
RLKSG

SEQ ID NO: 2771 - protein, 7 aa, Brucella spp.
LTPKQQS

SEQ ID NO: 2772 - protein, 9 aa, Brucella spp.
FYPGGPTAS

SEQ ID NO: 2773 - protein, 5 aa, Brucella spp.
NQGIA

SEQ ID NO: 2774 - protein, 7 aa, Brucella spp.
DSQGLSD

SEQ ID NO: 2775 - protein, 6 aa, Brucella spp.
ATGQSL

SEQ ID NO: 2776 - protein, 10 aa, Brucella spp.
PDFDPNNPVH

SEQ ID NO: 2777 - protein, 5 aa, Brucella spp.
RLNRM

SEQ ID NO: 2778 - protein, 7 aa, Brucella spp.
AGTYEMG

SEQ ID NO: 2779 - protein, 5 aa, Brucella spp.
LDASR

SEQ ID NO: 2780 - protein, 11 aa, Brucella spp.
IGSGREADAVG

SEQ ID NO: 2781 - protein, 4 aa, Brucella spp.
RPVE

SEQ ID NO: 2782 - protein, 11 aa, Brucella spp.
RTEAQAARASK

SEQ ID NO: 2783 - protein, 16 aa, Brucella spp.
STAPGGSGRRATVPGY

SEQ ID NO: 2784 - protein, 10 aa, Brucella spp.
VGGKTGTAEK

SEQ ID NO: 2785 - protein, 5 aa, Brucella spp.
NGRYS

SEQ ID NO: 2786 - protein, 17 aa, Brucella spp.
EPKPEEGKFSATAGLNA

SEQ ID NO: 2787 - protein, 30 aa, Brucella spp.
EALPASVENVSGRPDFQQEVPPAMVSNEYD

SEQ ID NO: 2788 - protein, 8 aa, Brucella spp.
APGEAGEV

SEQ ID NO: 2789 - protein, 10 aa, Brucella spp.
GITSDSRAVQ

SEQ ID NO: 2790 - protein, 5 aa, Brucella spp.
VKADG

SEQ ID NO: 2791 - protein, 7 aa, Brucella spp.
DAAKRGA

SEQ ID NO: 2792 - protein, 8 aa, Brucella spp.
KDTAIADA

SEQ ID NO: 2793 - protein, 11 aa, Brucella spp.
TGTSGKTSVAS

SEQ ID NO: 2794 - protein, 7 aa, Brucella spp.
AANIGTT

SEQ ID NO: 2795 - protein, 17 aa, Brucella spp.
FSPTRSDYNSLTTPDPV

SEQ ID NO: 2796 - protein, 6 aa, Brucella spp.
ASEGVT

SEQ ID NO: 2797 - protein, 9 aa, Brucella spp.
ASSHGLDQR

SEQ ID NO: 2798 - protein, 6 aa, Brucella spp.
TVGRKG

SEQ ID NO: 2799 - protein, 6 aa, Brucella spp.
GAPGRL

SEQ ID NO: 2800 - protein, 9 aa, Brucella spp.
ATEDGAPAY

SEQ ID NO: 2801 - protein, 5 aa, Brucella spp.
KPEAL

SEQ ID NO: 2802 - protein, 11 aa, Brucella spp.
GGDRDKGKRPI

SEQ ID NO: 2803 - protein, 11 aa, Brucella spp.
DDNPRSEVPAQ

SEQ ID NO: 2804 - protein, 10 aa, Brucella spp.
ATGATEIGDR

SEQ ID NO: 2805 - protein, 7 aa, Brucella spp.
KGHEEGQ

SEQ ID NO: 2806 - protein, 4 aa, Brucella spp.
RPFG

SEQ ID NO: 2807 - protein, 7 aa, Brucella spp.
RTLKPGE

SEQ ID NO: 2808 - protein, 5 aa, Brucella spp.
EQFDG

SEQ ID NO: 2809 - protein, 6 aa, Brucella spp.
RARSKA

SEQ ID NO: 2810 - protein, 10 aa, Brucella spp.
SVGKTTTKEA

SEQ ID NO: 2811 - protein, 5 aa, Brucella spp.
ASAAS

SEQ ID NO: 2812 - protein, 4 aa, Brucella spp.
DKRF

SEQ ID NO: 2813 - protein, 4 aa, Brucella spp.
EKAG

SEQ ID NO: 2814 - protein, 8 aa, Brucella spp.
GENARADY

SEQ ID NO: 2815 - protein, 8 aa, Brucella spp.
SAQGGRGA

SEQ ID NO: 2816 - protein, 8 aa, Brucella spp.
YNANPTSM

SEQ ID NO: 2817 - protein, 10 aa, Brucella spp.
TVPEGSRGRR

SEQ ID NO: 2818 - protein, 7 aa, Brucella spp.
GRQSGKL

SEQ ID NO: 2819 - protein, 7 aa, Brucella spp.
EYRQSTD

SEQ ID NO: 2820 - protein, 7 aa, Brucella spp.
SSNRTGF

SEQ ID NO: 2821 - protein, 17 aa, Brucella spp.
RQGKGQPIRADGPQTHF

SEQ ID NO: 2822 - protein, 7 aa, Brucella spp.
KAGTPTM

SEQ ID NO: 2823 - protein, 12 aa, Brucella spp.
TKQSDKGFSGKA

SEQ ID NO: 2824 - protein, 6 aa, Brucella spp.
QEPFSS

SEQ ID NO: 2825 - protein, 6 aa, Brucella spp.
VNLTDG

SEQ ID NO: 2826 - protein, 6 aa, Brucella spp.
KGWTES

SEQ ID NO: 2827 - protein, 6 aa, Brucella spp.
GSGIAT

SEQ ID NO: 2828 - protein, 20 aa, Brucella spp.
DNPDSVARAQSAGIATGDLR

SEQ ID NO: 2829 - protein, 5 aa, Brucella spp.
THPQP

SEQ ID NO: 2830 - protein, 10 aa, Brucella spp.
GTNGKSTTTA

SEQ ID NO: 2831 - protein, 6 aa, Brucella spp.
TGRDMQ

SEQ ID NO: 2832 - protein, 7 aa, Brucella spp.
PSLNPTA

SEQ ID NO: 2833 - protein, 4 aa, Brucella spp.
HGSM

SEQ ID NO: 2834 - protein, 4 aa, Brucella spp.
KHLD

SEQ ID NO: 2835 - protein, 5 aa, Brucella spp.
GEIDE

SEQ ID NO: 2836 - protein, 9 aa, Brucella spp.
RGAHNAQNA

SEQ ID NO: 2837 - protein, 5 aa, Brucella spp.
QVGRR

SEQ ID NO: 2838 - protein, 16 aa, Brucella spp.
SKATNAEATAPALSSF

SEQ ID NO: 2839 - protein, 7 aa, Brucella spp.
PKAGGIN

SEQ ID NO: 2840 - protein, 13 aa, Brucella spp.
AAGDAGNDAAPEP

SEQ ID NO: 2841 - protein, 6 aa, Brucella spp.
KRGDAF

SEQ ID NO: 2842 - protein, 5 aa, Brucella spp.
SPAVA

SEQ ID NO: 2843 - protein, 4 aa, Brucella spp.
IQPS

SEQ ID NO: 2844 - protein, 9 aa, Brucella spp.
RERGGDMPG

SEQ ID NO: 2845 - protein, 8 aa, Brucella spp.
EGDTFQVD

SEQ ID NO: 2846 - protein, 9 aa, Brucella spp.
GQGPGEGTV

SEQ ID NO: 2847 - protein, 6 aa, Brucella spp.
RRPEAR

SEQ ID NO: 2848 - protein, 6 aa, Brucella spp.
GGTGGH

SEQ ID NO: 2849 - protein, 5 aa, Brucella spp.
DARAQ

SEQ ID NO: 2850 - protein, 6 aa, Brucella spp.
IAGRNP

SEQ ID NO: 2851 - protein, 10 aa, Brucella spp.
GRANKGLAGR

SEQ ID NO: 2852 - protein, 10 aa, Brucella spp.
LPENSGAYAA

SEQ ID NO: 2853 - protein, 6 aa, Brucella spp.
TGNPVR

SEQ ID NO: 2854 - protein, 11 aa, Brucella spp.
TPYTPAGKDDR

SEQ ID NO: 2855 - protein, 4 aa, Brucella spp.
SQGA

SEQ ID NO: 2856 - protein, 14 aa, Brucella spp.
QARKEDEASARQAY

SEQ ID NO: 2857 - protein, 7 aa, Brucella spp.
SGASTVS

SEQ ID NO: 2858 - protein, 18 aa, Brucella spp.
HDQAANAAALAAAGGAEV

SEQ ID NO: 2859 - protein, 6 aa, Brucella spp.
DLSPQR

SEQ ID NO: 2860 - protein, 16 aa, Brucella spp.
EQQAKAAKSVGKPDAA

SEQ ID NO: 2861 - protein, 16 aa, Brucella spp.
IASGKTVQEFKEGNRP

SEQ ID NO: 2862 - protein, 14 aa, Brucella spp.
VQGSDQSDSANVQR

SEQ ID NO: 2863 - protein, 6 aa, Brucella spp.
AENLGD

SEQ ID NO: 2864 - protein, 8 aa, Brucella spp.
KKNNPELV

SEQ ID NO: 2865 - protein, 11 aa, Brucella spp.
GGTHGKTTTTS

SEQ ID NO: 2866 - protein, 7 aa, Brucella spp.
TNARMGD

SEQ ID NO: 2867 - protein, 6 aa, Brucella spp.
DESDGT

SEQ ID NO: 2868 - protein, 7 aa, Brucella spp.
GSNPQAE

SEQ ID NO: 2869 - protein, 8 aa, Brucella spp.
RKGEATEI

SEQ ID NO: 2870 - protein, 5 aa, Brucella spp.
SNATA

SEQ ID NO: 2871 - protein, 8 aa, Brucella spp.
SSDDIRRG

SEQ ID NO: 2872 - protein, 5 aa, Brucella spp.
THTGS

SEQ ID NO: 2873 - protein, 11 aa, Brucella spp.
AREATSQAGGR

SEQ ID NO: 2874 - protein, 12 aa, Brucella spp.
AGEEPIEGVNSE

SEQ ID NO: 2875 - protein, 16 aa, Brucella spp.
TAGHRDARYATGPEAL

SEQ ID NO: 2876 - protein, 4 aa, Brucella spp.
GRLS

SEQ ID NO: 2877 - protein, 9 aa, Brucella spp.
GRLTPDTGM

SEQ ID NO: 2878 - protein, 4 aa, Brucella spp.
GGPA

SEQ ID NO: 2879 - protein, 7 aa, Brucella spp.
PSDEEDL

SEQ ID NO: 2880 - protein, 5 aa, Brucella spp.
KGFGE

SEQ ID NO: 2881 - protein, 11 aa, Brucella spp.
RAGAAAPDKRV

SEQ ID NO: 2882 - protein, 4 aa, Brucella spp.
GGIG

SEQ ID NO: 2883 - protein, 10 aa, Brucella spp.
AGANGVETRE

SEQ ID NO: 2884 - protein, 7 aa, Brucella spp.
HSSASPD

SEQ ID NO: 2885 - protein, 8 aa, Brucella spp.
VPGERDDI

SEQ ID NO: 2886 - protein, 24 aa, Brucella spp.
ETVQPVREKTGGSTFKNPEGTSAW

SEQ ID NO: 2887 - protein, 8 aa, Brucella spp.
GNATGHDL

SEQ ID NO: 2888 - protein, 13 aa, Brucella spp.
RRAGAVRDASGAM

SEQ ID NO: 2889 - protein, 4 aa, Brucella spp.
PRHA

SEQ ID NO: 2890 - protein, 6 aa, Brucella spp.
KATAST

SEQ ID NO: 2891 - protein, 8 aa, Brucella spp.
GNNETSDI

SEQ ID NO: 2892 - protein, 5 aa, Brucella spp.
DGETS

SEQ ID NO: 2893 - protein, 8 aa, Brucella spp.
AEEARQSI

SEQ ID NO: 2894 - protein, 8 aa, Brucella spp.
EGAEKKVK

SEQ ID NO: 2895 - protein, 6 aa, Brucella spp.
SGMEQR

SEQ ID NO: 2896 - protein, 13 aa, Brucella spp.
DRKKELSRMGNRV

SEQ ID NO: 2897 - protein, 6 aa, Brucella spp.
HGTAGR

SEQ ID NO: 2898 - protein, 5 aa, Brucella spp.
PHEGG

SEQ ID NO: 2899 - protein, 4 aa, Brucella spp.
PGRT

SEQ ID NO: 2900 - protein, 8 aa, Brucella spp.
QRSRGVKS

SEQ ID NO: 2901 - protein, 4 aa, Brucella spp.
AEQS

SEQ ID NO: 2902 - protein, 8 aa, Brucella spp.
RLKSETFT

SEQ ID NO: 2903 - protein, 8 aa, Brucella spp.
GHEVEQTD

SEQ ID NO: 2904 - protein, 8 aa, Brucella spp.
GAKQALAA

SEQ ID NO: 2905 - protein, 7 aa, Brucella spp.
DGERGIR

SEQ ID NO: 2906 - protein, 4 aa, Brucella spp.
AAPL

SEQ ID NO: 2907 - protein, 4 aa, Brucella spp.
PYAS

SEQ ID NO: 2908 - protein, 5 aa, Brucella spp.
DEAEM

SEQ ID NO: 2909 - protein, 6 aa, Brucella spp.
GGGTTT

SEQ ID NO: 2910 - protein, 4 aa, Brucella spp.
MEDA

SEQ ID NO: 2911 - protein, 9 aa, Brucella spp.
LPSAADDRD

SEQ ID NO: 2912 - protein, 16 aa, Brucella spp.
PPIGDDERDVPNQYPR

SEQ ID NO: 2913 - protein, 5 aa, Brucella spp.
LNQSG

SEQ ID NO: 2914 - protein, 11 aa, Brucella spp.
GGASQLPGMPE

SEQ ID NO: 2915 - protein, 11 aa, Brucella spp.
LPEAAKGAAFA

SEQ ID NO: 2916 - protein, 32 aa, Brucella spp.
IEERSVKAASSGLMTGTGGRIQRVGQWLRESF

SEQ ID NO: 2917 - protein, 8 aa, Brucella spp.
GGGGGNAV

SEQ ID NO: 2918 - protein, 8 aa, Brucella spp.
DAQALTMS

SEQ ID NO: 2919 - protein, 17 aa, Brucella spp.
TEGLGAGSQPEVGRAAA

SEQ ID NO: 2920 - protein, 12 aa, Brucella spp.
MGGGTGTGAAPV

SEQ ID NO: 2921 - protein, 4 aa, Brucella spp.
ARER

SEQ ID NO: 2922 - protein, 5 aa, Brucella spp.
DKTTF

SEQ ID NO: 2923 - protein, 12 aa, Brucella spp.
GTGEASGEGRAM

SEQ ID NO: 2924 - protein, 6 aa, Brucella spp.
TSMRGA

SEQ ID NO: 2925 - protein, 11 aa, Brucella spp.
ATRIREEVDPE

SEQ ID NO: 2926 - protein, 14 aa, Brucella spp.
GIDKQQGDAAPAPL

SEQ ID NO: 2927 - protein, 14 aa, Brucella spp.
VKPTAAQAKPMAPH

SEQ ID NO: 2928 - protein, 14 aa, Brucella spp.
RPPVAEQPRQADPV

SEQ ID NO: 2929 - protein, 4 aa, Brucella spp.
AEMP

SEQ ID NO: 2930 - protein, 16 aa, Brucella spp.
VAPAASAASAEPEFRP

SEQ ID NO: 2931 - protein, 7 aa, Brucella spp.
PAPEAFE

SEQ ID NO: 2932 - protein, 7 aa, Brucella spp.
RAPMQPA

SEQ ID NO: 2933 - protein, 12 aa, Brucella spp.
HAPQPQQYQQPQ

SEQ ID NO: 2934 - protein, 12 aa, Brucella spp.
QPVREPRPAPRM

SEQ ID NO: 2935 - protein, 4 aa, Brucella spp.
FPPV

SEQ ID NO: 2936 - protein, 19 aa, Brucella spp.
INARRAPQQPVQEEPRGPM

SEQ ID NO: 2937 - protein, 34 aa, Brucella spp.
LSRREEEQPAARLEPAQHREPGYAPSRTAPPDAA

SEQ ID NO: 2938 - protein, 9 aa, Brucella spp.
HGGAPASAR

SEQ ID NO: 2939 - protein, 6 aa, Brucella spp.
PADADT

SEQ ID NO: 2940 - protein, 6 aa, Brucella spp.
IKDSAP

SEQ ID NO: 2941 - protein, 6 aa, Brucella spp.
AREARI

SEQ ID NO: 2942 - protein, 4 aa, Brucella spp.
TQDA

SEQ ID NO: 2943 - protein, 6 aa, Brucella spp.
EAGNSW

SEQ ID NO: 2944 - protein, 5 aa, Brucella spp.
PYDGT

SEQ ID NO: 2945 - protein, 6 aa, Brucella spp.
DEETFR

SEQ ID NO: 2946 - protein, 4 aa, Brucella spp.
LSTA

SEQ ID NO: 2947 - protein, 5 aa, Brucella spp.
NSIVN

SEQ ID NO: 2948 - protein, 9 aa, Brucella spp.
RGGHRLNSE

SEQ ID NO: 2949 - protein, 8 aa, Brucella spp.
ASKNDDID

SEQ ID NO: 2950 - protein, 9 aa, Brucella spp.
TIDPADKLY

SEQ ID NO: 2951 - protein, 8 aa, Brucella spp.
AGRLDEAA

SEQ ID NO: 2952 - protein, 5 aa, Brucella spp.
HPYTE

SEQ ID NO: 2953 - protein, 8 aa, Brucella spp.
RKGNYEEA

SEQ ID NO: 2954 - protein, 9 aa, Brucella spp.
LYPTSPESA

SEQ ID NO: 2955 - protein, 11 aa, Brucella spp.
VTRDQAASRRA

SEQ ID NO: 2956 - protein, 14 aa, Brucella spp.
PNSEYTDDAKTKIR

SEQ ID NO: 2957 - protein, 7 aa, Brucella spp.
DQLAGKE

SEQ ID NO: 2958 - protein, 8 aa, Brucella spp.
YSNTRQVE

SEQ ID NO: 2959 - protein, 4 aa, Brucella spp.
SEAQ

SEQ ID NO: 2960 - protein, 7 aa, Brucella spp.
NFPDSQW

SEQ ID NO: 2961 - protein, 11 aa, Brucella spp.
GGLQPRENGNS

SEQ ID NO: 2962 - protein, 9 aa, Brucella spp.
TGETGAGKS

SEQ ID NO: 2963 - protein, 7 aa, Brucella spp.
GARGDAS

SEQ ID NO: 2964 - protein, 7 aa, Brucella spp.
GADQGQV

SEQ ID NO: 2965 - protein, 5 aa, Brucella spp.
PGNHP

SEQ ID NO: 2966 - protein, 6 aa, Brucella spp.
GFDDDG

SEQ ID NO: 2967 - protein, 4 aa, Brucella spp.
GDGR

SEQ ID NO: 2968 - protein, 4 aa, Brucella spp.
QHDD

SEQ ID NO: 2969 - protein, 8 aa, Brucella spp.
WRDAESAL

SEQ ID NO: 2970 - protein, 13 aa, Brucella spp.
ARVEQAEREGDYL

SEQ ID NO: 2971 - protein, 14 aa, Brucella spp.
LDPQPGEEEELAER

SEQ ID NO: 2972 - protein, 12 aa, Brucella spp.
KIAGDVNEAGEL

SEQ ID NO: 2973 - protein, 11 aa, Brucella spp.
LSGQGSPVPSL

SEQ ID NO: 2974 - protein, 7 aa, Brucella spp.
ARAQDGI

SEQ ID NO: 2975 - protein, 7 aa, Brucella spp.
DLDAGAE

SEQ ID NO: 2976 - protein, 17 aa, Brucella spp.
DEAAAQLSAARKETAGH

SEQ ID NO: 2977 - protein, 11 aa, Brucella spp.
TDPQTRTAEGI

SEQ ID NO: 2978 - protein, 9 aa, Brucella spp.
TNPGTRAGP

SEQ ID NO: 2979 - protein, 8 aa, Brucella spp.
ADRGSAPT

SEQ ID NO: 2980 - protein, 6 aa, Brucella spp.
TGVGGA

SEQ ID NO: 2981 - protein, 6 aa, Brucella spp.
PQVAAR

SEQ ID NO: 2982 - protein, 7 aa, Brucella spp.
ATHEDRM

SEQ ID NO: 2983 - protein, 7 aa, Brucella spp.
TDERQEE

SEQ ID NO: 2984 - protein, 10 aa, Brucella spp.
SITDEARAAA

SEQ ID NO: 2985 - protein, 10 aa, Brucella spp.
KDRPEISDAA

SEQ ID NO: 2986 - protein, 6 aa, Brucella spp.
KRRNEA

SEQ ID NO: 2987 - protein, 11 aa, Brucella spp.
DDSPSRRVGAA

SEQ ID NO: 2988 - protein, 5 aa, Brucella spp.
FSDED

SEQ ID NO: 2989 - protein, 7 aa, Brucella spp.
AEPKIDG

SEQ ID NO: 2990 - protein, 14 aa, Brucella spp.
GATRGDGTTGENVT

SEQ ID NO: 2991 - protein, 9 aa, Brucella spp.
NRLPAGAPA

SEQ ID NO: 2992 - protein, 21 aa, Brucella spp.
MEAEGKQTYVNPRNTAAGSLR

SEQ ID NO: 2993 - protein, 6 aa, Brucella spp.
KVTASR

SEQ ID NO: 2994 - protein, 7 aa, Brucella spp.
DMPADTQ

SEQ ID NO: 2995 - protein, 5 aa, Brucella spp.
SRSPR

SEQ ID NO: 2996 - protein, 6 aa, Brucella spp.
RTGALT

SEQ ID NO: 2997 - protein, 11 aa, Brucella spp.
IGQKGEPIREG

SEQ ID NO: 2998 - protein, 9 aa, Brucella spp.
EGKKRGEPY

SEQ ID NO: 2999 - protein, 11 aa, Brucella spp.
AVREEGEAVRR

SEQ ID NO: 3000 - protein, 7 aa, Brucella spp.
RQENSLT

SEQ ID NO: 3001 - protein, 5 aa, Brucella spp.
FGATS

SEQ ID NO: 3002 - protein, 18 aa, Brucella spp.
EAVPPKEGDRTDKGSEAW

SEQ ID NO: 3003 - protein, 4 aa, Brucella spp.
EPHN

SEQ ID NO: 3004 - protein, 18 aa, Brucella spp.
TPLDEEARVATGSPVEGK

SEQ ID NO: 3005 - protein, 26 aa, Brucella spp.
RMSRDEAKAMAERHGAKTAGSVSKKT

SEQ ID NO: 3006 - protein, 14 aa, Brucella spp.
AGPGAGSKLAKATE

SEQ ID NO: 3007 - protein, 9 aa, Brucella spp.
PANGAPRVE

SEQ ID NO: 3008 - protein, 11 aa, Brucella spp.
DEHQGEYVPPH

SEQ ID NO: 3009 - protein, 6 aa, Brucella spp.
TGSAGA

SEQ ID NO: 3010 - protein, 7 aa, Brucella spp.
RAQTDGK

SEQ ID NO: 3011 - protein, 6 aa, Brucella spp.
STPPAS

SEQ ID NO: 3012 - protein, 7 aa, Brucella spp.
AENGKGL

SEQ ID NO: 3013 - protein, 8 aa, Brucella spp.
LEKQGGQL

SEQ ID NO: 3014 - protein, 9 aa, Brucella spp.
DQPEAPAAE

SEQ ID NO: 3015 - protein, 13 aa, Brucella spp.
FSGHEAKDKISEM

SEQ ID NO: 3016 - protein, 16 aa, Brucella spp.
VAASGASATVLTDPSS

SEQ ID NO: 3017 - protein, 8 aa, Brucella spp.
KDVSNTPL

SEQ ID NO: 3018 - protein, 5 aa, Brucella spp.
AQGEP

SEQ ID NO: 3019 - protein, 8 aa, Brucella spp.
LSAPADLE

SEQ ID NO: 3020 - protein, 7 aa, Brucella spp.
ARAARGE

SEQ ID NO: 3021 - protein, 17 aa, Brucella spp.
AGGSVIEGKDPARIPRA

SEQ ID NO: 3022 - protein, 16 aa, Brucella spp.
NKAELDGSRAAHERDG

SEQ ID NO: 3023 - protein, 9 aa, Brucella spp.
QKPGTIDEI

SEQ ID NO: 3024 - protein, 14 aa, Brucella spp.
AKKLEESRANAGRD

SEQ ID NO: 3025 - protein, 9 aa, Brucella spp.
ISGAGPNGA

SEQ ID NO: 3026 - protein, 9 aa, Brucella spp.
TDTNRTLQD

SEQ ID NO: 3027 - protein, 13 aa, Brucella spp.
GAQYRDGTTDITR

SEQ ID NO: 3028 - protein, 5 aa, Brucella spp.
IDPET

SEQ ID NO: 3029 - protein, 9 aa, Brucella spp.
FPKGTRGQD

SEQ ID NO: 3030 - protein, 7 aa, Brucella spp.
HGTGHGV

SEQ ID NO: 3031 - protein, 13 aa, Brucella spp.
EGPQSISRKGAQE

SEQ ID NO: 3032 - protein, 7 aa, Brucella spp.
EPGYYKP

SEQ ID NO: 3033 - protein, 5 aa, Brucella spp.
VLPGG

SEQ ID NO: 3034 - protein, 8 aa, Brucella spp.
SGHLGDAE

SEQ ID NO: 3035 - protein, 10 aa, Brucella spp.
KQAAKEPFGG

SEQ ID NO: 3036 - protein, 12 aa, Brucella spp.
GKPFSEKDLRAT

SEQ ID NO: 3037 - protein, 7 aa, Brucella spp.
LGPEAGD

SEQ ID NO: 3038 - protein, 8 aa, Brucella spp.
DPERDTQD

SEQ ID NO: 3039 - protein, 7 aa, Brucella spp.
TGTPDNI

SEQ ID NO: 3040 - protein, 9 aa, Brucella spp.
IEDGDYTMD

SEQ ID NO: 3041 - protein, 4 aa, Brucella spp.
GRFR

SEQ ID NO: 3042 - protein, 9 aa, Brucella spp.
YQENPDTAL

SEQ ID NO: 3043 - protein, 8 aa, Brucella spp.
AAPAEEVG

SEQ ID NO: 3044 - protein, 4 aa, Brucella spp.
DPKV

SEQ ID NO: 3045 - protein, 14 aa, Brucella spp.
ENPSNASISCEQTG

SEQ ID NO: 3046 - protein, 8 aa, Brucella spp.
LGKGGERV

SEQ ID NO: 3047 - protein, 4 aa, Brucella spp.
KTNN

SEQ ID NO: 3048 - protein, 13 aa, Brucella spp.
QVQDGSAKTSLST

SEQ ID NO: 3049 - protein, 4 aa, Brucella spp.
GDQI

SEQ ID NO: 3050 - protein, 7 aa, Brucella spp.
AGDPETR

SEQ ID NO: 3051 - protein, 7 aa, Brucella spp.
TDKDGLY

SEQ ID NO: 3052 - protein, 7 aa, Brucella spp.
RPSDPKW

SEQ ID NO: 3053 - protein, 5 aa, Brucella spp.
DLAKP

SEQ ID NO: 3054 - protein, 4 aa, Brucella spp.
PEGE

SEQ ID NO: 3055 - protein, 4 aa, Brucella spp.
TPTE

SEQ ID NO: 3056 - protein, 17 aa, Brucella spp.
SDGEGTGDRIDNEGPAI

SEQ ID NO: 3057 - protein, 7 aa, Brucella spp.
KSDPRVS

SEQ ID NO: 3058 - protein, 13 aa, Brucella spp.
NADEKSLRARLKG

SEQ ID NO: 3059 - protein, 9 aa, Brucella spp.
PRRADGTIR

SEQ ID NO: 3060 - protein, 4 aa, Brucella spp.
REPE

SEQ ID NO: 3061 - protein, 4 aa, Brucella spp.
NDAF

SEQ ID NO: 3062 - protein, 9 aa, Brucella spp.
AGATADNTE

SEQ ID NO: 3063 - protein, 4 aa, Brucella spp.
NRED

SEQ ID NO: 3064 - protein, 6 aa, Brucella spp.
LPQRED

SEQ ID NO: 3065 - protein, 13 aa, Brucella spp.
VGQDPVALALPAA

SEQ ID NO: 3066 - protein, 5 aa, Brucella spp.
NEAGI

SEQ ID NO: 3067 - protein, 25 aa, Brucella spp.
GERAQTGQAIREQHGHTTTYVPTQA

SEQ ID NO: 3068 - protein, 6 aa, Brucella spp.
NTQDVQ

SEQ ID NO: 3069 - protein, 16 aa, Brucella spp.
AGSSLEGQVNAPAGGV

SEQ ID NO: 3070 - protein, 21 aa, Brucella spp.
PGANATLGGMASTRASGTNAV

SEQ ID NO: 3071 - protein, 13 aa, Brucella spp.
ETSKRVKKTAAGY

SEQ ID NO: 3072 - protein, 4 aa, Brucella spp.
PYEA

SEQ ID NO: 3073 - protein, 9 aa, Brucella spp.
TESGVGEQA

SEQ ID NO: 3074 - protein, 7 aa, Brucella spp.
AGHGGGA

SEQ ID NO: 3075 - protein, 6 aa, Brucella spp.
DAEERD

SEQ ID NO: 3076 - protein, 4 aa, Brucella spp.
KGVS

SEQ ID NO: 3077 - protein, 10 aa, Brucella spp.
GETEKDLAET

SEQ ID NO: 3078 - protein, 8 aa, Brucella spp.
DDASEMER

SEQ ID NO: 3079 - protein, 11 aa, Brucella spp.
TCTGEHGIGQG

SEQ ID NO: 3080 - protein, 15 aa, Brucella spp.
ALDPDNIMNPGKILI

SEQ ID NO: 3081 - protein, 5 aa, Brucella spp.
FEREA

SEQ ID NO: 3082 - protein, 6 aa, Brucella spp.
DKDGKV

SEQ ID NO: 3083 - protein, 10 aa, Brucella spp.
PSTPLDPTKI

SEQ ID NO: 3084 - protein, 12 aa, Brucella spp.
EEASGRSDTASA

SEQ ID NO: 3085 - protein, 8 aa, Brucella spp.
SLAGPWQA

SEQ ID NO: 3086 - protein, 10 aa, Brucella spp.
SSGEAKPDGV

SEQ ID NO: 3087 - protein, 6 aa, Brucella spp.
VSPDGF

SEQ ID NO: 3088 - protein, 6 aa, Brucella spp.
DVAMTD

SEQ ID NO: 3089 - protein, 9 aa, Brucella spp.
GLKKPAEKP

SEQ ID NO: 3090 - protein, 9 aa, Brucella spp.
GKFKADRER

SEQ ID NO: 3091 - protein, 10 aa, Brucella spp.
EQGPADNPYV

SEQ ID NO: 3092 - protein, 11 aa, Brucella spp.
NETAGEEQSVS

SEQ ID NO: 3093 - protein, 5 aa, Brucella spp.
PSIPG

SEQ ID NO: 3094 - protein, 4 aa, Brucella spp.
GGTT

SEQ ID NO: 3095 - protein, 8 aa, Brucella spp.
AEPDGEDW

SEQ ID NO: 3096 - protein, 15 aa, Brucella spp.
DLPGRTKVEAKGKLS

SEQ ID NO: 3097 - protein, 7 aa, Brucella spp.
SRQPSGL

SEQ ID NO: 3098 - protein, 4 aa, Brucella spp.
VDES

SEQ ID NO: 3099 - protein, 8 aa, Brucella spp.
EGAGFSGK

SEQ ID NO: 3100 - protein, 8 aa, Brucella spp.
LRDGTQRI

SEQ ID NO: 3101 - protein, 4 aa, Brucella spp.
TSLH

SEQ ID NO: 3102 - protein, 8 aa, Brucella spp.
KGAAQPSI

SEQ ID NO: 3103 - protein, 4 aa, Brucella spp.
GPVR

SEQ ID NO: 3104 - protein, 21 aa, Brucella spp.
ATLTATGTYEPFANTPSGSLD

SEQ ID NO: 3105 - protein, 28 aa, Brucella spp.
APADGALKKTLAKNAAAREKSAKPIEAN

SEQ ID NO: 3106 - protein, 7 aa, Brucella spp.
NKAPGVG

SEQ ID NO: 3107 - protein, 7 aa, Brucella spp.
TGKSGGM

SEQ ID NO: 3108 - protein, 14 aa, Brucella spp.
SGTASGGEGESEPL

SEQ ID NO: 3109 - protein, 9 aa, Brucella spp.
GTATSRQGE

SEQ ID NO: 3110 - protein, 8 aa, Brucella spp.
QGAPSAGM

SEQ ID NO: 3111 - protein, 9 aa, Brucella spp.
SAPDGSAMA

SEQ ID NO: 3112 - protein, 12 aa, Brucella spp.
IAASGKAQLKTA

SEQ ID NO: 3113 - protein, 4 aa, Brucella spp.
NGDN

SEQ ID NO: 3114 - protein, 13 aa, Brucella spp.
ADSGLPQLKGEAK

SEQ ID NO: 3115 - protein, 11 aa, Brucella spp.
FEPAKPTAKTI

SEQ ID NO: 3116 - protein, 10 aa, Brucella spp.
LRNSDKNALL

SEQ ID NO: 3117 - protein, 9 aa, Brucella spp.
NLNGSGDSV

SEQ ID NO: 3118 - protein, 7 aa, Brucella spp.
LGGTATL

SEQ ID NO: 3119 - protein, 13 aa, Brucella spp.
ALEDRTPSTKKLD

SEQ ID NO: 3120 - protein, 9 aa, Brucella spp.
EKATGQSVF

SEQ ID NO: 3121 - protein, 4 aa, Brucella spp.
APGN

SEQ ID NO: 3122 - protein, 8 aa, Brucella spp.
NLKDGDAA

SEQ ID NO: 3123 - protein, 6 aa, Brucella spp.
VSGNGT

SEQ ID NO: 3124 - protein, 11 aa, Brucella spp.
NGAGDETGIAP

SEQ ID NO: 3125 - protein, 7 aa, Brucella spp.
HYSQPTV

SEQ ID NO: 3126 - protein, 8 aa, Brucella spp.
LEREQERV

SEQ ID NO: 3127 - protein, 32 aa, Brucella spp.
AAERERSLREEEARRRADANAPLALPEGGQSL

SEQ ID NO: 3128 - protein, 15 aa, Brucella spp.
KQKARDTKEKQAEQN

SEQ ID NO: 3129 - protein, 13 aa, Brucella spp.
EKDFARAQAQKAE

SEQ ID NO: 3130 - protein, 12 aa, Brucella spp.
RRETKDLPEGEK

SEQ ID NO: 3131 - protein, 7 aa, Brucella spp.
DAAADEA

SEQ ID NO: 3132 - protein, 16 aa, Brucella spp.
NRDSSLVSASDPEEMK

SEQ ID NO: 3133 - protein, 9 aa, Brucella spp.
VEDVAKGDE

SEQ ID NO: 3134 - protein, 7 aa, Brucella spp.
KGDRNKH

SEQ ID NO: 3135 - protein, 13 aa, Brucella spp.
VDRDDRTGTGTRS

SEQ ID NO: 3136 - protein, 8 aa, Brucella spp.
DENGDLGP

SEQ ID NO: 3137 - protein, 8 aa, Brucella spp.
WPAPDGRH

SEQ ID NO: 3138 - protein, 6 aa, Brucella spp.
TNPQSR

SEQ ID NO: 3139 - protein, 6 aa, Brucella spp.
TRTPKK

SEQ ID NO: 3140 - protein, 13 aa, Brucella spp.
YEADPTIKAPIAV

SEQ ID NO: 3141 - protein, 9 aa, Brucella spp.
ENNVIGQEN

SEQ ID NO: 3142 - protein, 6 aa, Brucella spp.
RPLPGR

SEQ ID NO: 3143 - protein, 6 aa, Brucella spp.
FRAEGA

SEQ ID NO: 3144 - protein, 6 aa, Brucella spp.
AAEGGV

SEQ ID NO: 3145 - protein, 23 aa, Brucella spp.
EDVPAGDKDSYPTRYMLYERRVS

SEQ ID NO: 3146 - protein, 35 aa, Brucella spp.
PWGGGGDNNNNNNNGPWGQGPKGPRGGGQNTPPDL

SEQ ID NO: 3147 - protein, 5 aa, Brucella spp.
KGQDR

SEQ ID NO: 3148 - protein, 12 aa, Brucella spp.
FPGGGGRKGSNR

SEQ ID NO: 3149 - protein, 10 aa, Brucella spp.
GKPKEEVSEP

SEQ ID NO: 3150 - protein, 11 aa, Brucella spp.
IGGQGTRNATQ

SEQ ID NO: 3151 - protein, 6 aa, Brucella spp.
RRPAQD

SEQ ID NO: 3152 - protein, 7 aa, Brucella spp.
NRSAIAQ

SEQ ID NO: 3153 - protein, 9 aa, Brucella spp.
EDAAPPREV

SEQ ID NO: 3154 - protein, 10 aa, Brucella spp.
QRAEQDEDRF

SEQ ID NO: 3155 - protein, 29 aa, Brucella spp.
EESNQYSNQKLGQARGEAAQLREEAAAYK

SEQ ID NO: 3156 - protein, 10 aa, Brucella spp.
QDAEGEAQRF

SEQ ID NO: 3157 - protein, 8 aa, Brucella spp.
QKAPEVTR

SEQ ID NO: 3158 - protein, 4 aa, Brucella spp.
VEPG

SEQ ID NO: 3159 - protein, 21 aa, Brucella spp.
KQPSTGVKAPTTTTTTGGGNQ

SEQ ID NO: 3160 - protein, 11 aa, Brucella spp.
NPAKAALAPSL

SEQ ID NO: 3161 - protein, 6 aa, Brucella spp.
SAAVNA

SEQ ID NO: 3162 - protein, 15 aa, Brucella spp.
ASEADASLRATLDGA

SEQ ID NO: 3163 - protein, 6 aa, Brucella spp.
EQERRR

SEQ ID NO: 3164 - protein, 5 aa, Brucella spp.
EEAGL

SEQ ID NO: 3165 - protein, 8 aa, Brucella spp.
LTPGGPQL

SEQ ID NO: 3166 - protein, 5 aa, Brucella spp.
EERAN

SEQ ID NO: 3167 - protein, 8 aa, Brucella spp.
DGTRLTGT

SEQ ID NO: 3168 - protein, 6 aa, Brucella spp.
GLTPED

SEQ ID NO: 3169 - protein, 7 aa, Brucella spp.
VGDGAND

SEQ ID NO: 3170 - protein, 7 aa, Brucella spp.
KPAVAAQ

SEQ ID NO: 3171 - protein, 14 aa, Brucella spp.
AGQAQDAGHPREMT

SEQ ID NO: 3172 - protein, 17 aa, Brucella spp.
EQGAGHAAEGYARSTGK

SEQ ID NO: 3173 - protein, 12 aa, Brucella spp.
SGPGATNAVTPL

SEQ ID NO: 3174 - protein, 4 aa, Brucella spp.
PTTL

SEQ ID NO: 3175 - protein, 7 aa, Brucella spp.
STGRPGP

SEQ ID NO: 3176 - protein, 13 aa, Brucella spp.
YTPPETAPRTSYR

SEQ ID NO: 3177 - protein, 7 aa, Brucella spp.
GNAEAIS

SEQ ID NO: 3178 - protein, 10 aa, Brucella spp.
VINSGPAASR

SEQ ID NO: 3179 - protein, 7 aa, Brucella spp.
AYPASGK

SEQ ID NO: 3180 - protein, 6 aa, Brucella spp.
FSPNSK

SEQ ID NO: 3181 - protein, 7 aa, Brucella spp.
PSSINKN

SEQ ID NO: 3182 - protein, 7 aa, Brucella spp.
RKPDRQA

SEQ ID NO: 3183 - protein, 7 aa, Brucella spp.
LAYTPNK

SEQ ID NO: 3184 - protein, 5 aa, Brucella spp.
NRNTY

SEQ ID NO: 3185 - protein, 5 aa, Brucella spp.
GGLGT

SEQ ID NO: 3186 - protein, 7 aa, Brucella spp.
EKPGDLD

SEQ ID NO: 3187 - protein, 4 aa, Brucella spp.
GKAH

SEQ ID NO: 3188 - protein, 9 aa, Brucella spp.
DEATDEAVA

SEQ ID NO: 3189 - protein, 8 aa, Brucella spp.
ETQTPETH

SEQ ID NO: 3190 - protein, 4 aa, Brucella spp.
NEPG

SEQ ID NO: 3191 - protein, 8 aa, Brucella spp.
VSETEHER

SEQ ID NO: 3192 - protein, 6 aa, Brucella spp.
GHERPI

SEQ ID NO: 3193 - protein, 10 aa, Brucella spp.
AGKGEARAET

SEQ ID NO: 3194 - protein, 6 aa, Brucella spp.
GKSAKI

SEQ ID NO: 3195 - protein, 7 aa, Brucella spp.
GTGKTTL

SEQ ID NO: 3196 - protein, 10 aa, Brucella spp.
RSKGASNART

SEQ ID NO: 3197 - protein, 20 aa, Brucella spp.
PRGEEAIEDETTGKTSIAPT

SEQ ID NO: 3198 - protein, 6 aa, Brucella spp.
RQSPVA

SEQ ID NO: 3199 - protein, 9 aa, Brucella spp.
PGQLPPISG

SEQ ID NO: 3200 - protein, 6 aa, Brucella spp.
QARDNP

SEQ ID NO: 3201 - protein, 11 aa, Brucella spp.
EGRELSYGDYG

SEQ ID NO: 3202 - protein, 6 aa, Brucella spp.
GKSEVN

SEQ ID NO: 3203 - protein, 9 aa, Brucella spp.
TNRTRRRYN

SEQ ID NO: 3204 - protein, 8 aa, Brucella spp.
ADYPQAGD

SEQ ID NO: 3205 - protein, 7 aa, Brucella spp.
NDPTKGL

SEQ ID NO: 3206 - protein, 9 aa, Brucella spp.
SSKETVKPG

SEQ ID NO: 3207 - protein, 8 aa, Brucella spp.
PEDEDRGV

SEQ ID NO: 3208 - protein, 10 aa, Brucella spp.
FEDPDTEIPW

SEQ ID NO: 3209 - protein, 6 aa, Brucella spp.
AQGSQW

SEQ ID NO: 3210 - protein, 6 aa, Brucella spp.
LAAGAA

SEQ ID NO: 3211 - protein, 6 aa, Brucella spp.
HPRPDQ

SEQ ID NO: 3212 - protein, 6 aa, Brucella spp.
DEYPQA

SEQ ID NO: 3213 - protein, 5 aa, Brucella spp.
HEPEQ

SEQ ID NO: 3214 - protein, 9 aa, Brucella spp.
DDPMQATSD

SEQ ID NO: 3215 - protein, 8 aa, Brucella spp.
PDSLGYER

SEQ ID NO: 3216 - protein, 6 aa, Brucella spp.
KAIGAD

SEQ ID NO: 3217 - protein, 17 aa, Brucella spp.
GPYGATHDDPAAAAREL

SEQ ID NO: 3218 - protein, 8 aa, Brucella spp.
KAARAATA

SEQ ID NO: 3219 - protein, 10 aa, Brucella spp.
AQAAVSAGSV

SEQ ID NO: 3220 - protein, 10 aa, Brucella spp.
ADEGEQHNES

SEQ ID NO: 3221 - protein, 4 aa, Brucella spp.
GTSP

SEQ ID NO: 3222 - protein, 7 aa, Brucella spp.
DNNGEGG

SEQ ID NO: 3223 - protein, 6 aa, Brucella spp.
LKGRPD

SEQ ID NO: 3224 - protein, 4 aa, Brucella spp.
LGTG

SEQ ID NO: 3225 - protein, 4 aa, Brucella spp.
TSEK

SEQ ID NO: 3226 - protein, 6 aa, Brucella spp.
KSSNLA

SEQ ID NO: 3227 - protein, 5 aa, Brucella spp.
RKAEV

SEQ ID NO: 3228 - protein, 8 aa, Brucella spp.
KRPPTIVP

SEQ ID NO: 3229 - protein, 9 aa, Brucella spp.
GDPKSAPTA

SEQ ID NO: 3230 - protein, 9 aa, Brucella spp.
ADRARVSQY

SEQ ID NO: 3231 - protein, 4 aa, Brucella spp.
PNIP

SEQ ID NO: 3232 - protein, 7 aa, Brucella spp.
TASDATE

SEQ ID NO: 3233 - protein, 7 aa, Brucella spp.
GSQGRAH

SEQ ID NO: 3234 - protein, 7 aa, Brucella spp.
KDSGAAN

SEQ ID NO: 3235 - protein, 13 aa, Brucella spp.
EGSATVQKAQADG

SEQ ID NO: 3236 - protein, 17 aa, Brucella spp.
KGPGHTVRGEYQKGGGV

SEQ ID NO: 3237 - protein, 7 aa, Brucella spp.
DASGNAH

SEQ ID NO: 3238 - protein, 10 aa, Brucella spp.
SGVGGGRSGV

SEQ ID NO: 3239 - protein, 6 aa, Brucella spp.
SNTAEW

SEQ ID NO: 3240 - protein, 7 aa, Brucella spp.
AETKAEM

SEQ ID NO: 3241 - protein, 5 aa, Brucella spp.
QTGKF

SEQ ID NO: 3242 - protein, 4 aa, Brucella spp.
IEEV

SEQ ID NO: 3243 - protein, 6 aa, Brucella spp.
KRMRAS

SEQ ID NO: 3244 - protein, 5 aa, Brucella spp.
GIPDP

SEQ ID NO: 3245 - protein, 9 aa, Brucella spp.
LGGPEANAA

SEQ ID NO: 3246 - protein, 5 aa, Brucella spp.
EGYKP

SEQ ID NO: 3247 - protein, 7 aa, Brucella spp.
SGSQQAL

SEQ ID NO: 3248 - protein, 5 aa, Brucella spp.
PGDTA

SEQ ID NO: 3249 - protein, 6 aa, Brucella spp.
YEPNYD

SEQ ID NO: 3250 - protein, 20 aa, Brucella spp.
KGNRTPQSYAQTAQKAGGQV

SEQ ID NO: 3251 - protein, 15 aa, Brucella spp.
FSNPTGETVDRAGRE

SEQ ID NO: 3252 - protein, 9 aa, Brucella spp.
RNGGDIEKT

SEQ ID NO: 3253 - protein, 5 aa, Brucella spp.
TLAPG

SEQ ID NO: 3254 - protein, 6 aa, Brucella spp.
DLHSST

SEQ ID NO: 3255 - protein, 5 aa, Brucella spp.
TKPEG

SEQ ID NO: 3256 - protein, 5 aa, Brucella spp.
EGMDG

SEQ ID NO: 3257 - protein, 4 aa, Brucella spp.
SIDS

SEQ ID NO: 3258 - protein, 8 aa, Brucella spp.
DGTGANTL

SEQ ID NO: 3259 - protein, 8 aa, Brucella spp.
HADDTRQM

SEQ ID NO: 3260 - protein, 7 aa, Brucella spp.
GNDSRGI

SEQ ID NO: 3261 - protein, 9 aa, Brucella spp.
TTRDGQPIE

SEQ ID NO: 3262 - protein, 16 aa, Brucella spp.
MSGARNGQDGRTSSHP

SEQ ID NO: 3263 - protein, 9 aa, Brucella spp.
FAAKNEHAV

SEQ ID NO: 3264 - protein, 31 aa, Brucella spp.
PEQNVDRYPRTGWDRPKASDHCPVSVTLNMV

SEQ ID NO: 3265 - protein, 6 aa, Brucella spp.
ALAGNP

SEQ ID NO: 3266 - protein, 7 aa, Brucella spp.
ANPAHEA

SEQ ID NO: 3267 - protein, 5 aa, Brucella spp.
HPTVG

SEQ ID NO: 3268 - protein, 11 aa, Brucella spp.
RRQKTGDETDR

SEQ ID NO: 3269 - protein, 7 aa, Brucella spp.
EREEAAA

SEQ ID NO: 3270 - protein, 6 aa, Brucella spp.
PHVGGR

SEQ ID NO: 3271 - protein, 10 aa, Brucella spp.
YEDPATGSAV

SEQ ID NO: 3272 - protein, 9 aa, Brucella spp.
NDKPVDGSS

SEQ ID NO: 3273 - protein, 5 aa, Brucella spp.
MGRPS

SEQ ID NO: 3274 - protein, 4 aa, Brucella spp.
IGGT

SEQ ID NO: 3275 - protein, 12 aa, Brucella spp.
TTDGQKTNAMRK

SEQ ID NO: 3276 - protein, 4 aa, Brucella spp.
SQTK

SEQ ID NO: 3277 - protein, 7 aa, Brucella spp.
AREDEEE

SEQ ID NO: 3278 - protein, 11 aa, Brucella spp.
KTITKEGTARA

SEQ ID NO: 3279 - protein, 7 aa, Brucella spp.
PANNPID

SEQ ID NO: 3280 - protein, 6 aa, Brucella spp.
AESLGL

SEQ ID NO: 3281 - protein, 6 aa, Brucella spp.
ETGRLS

SEQ ID NO: 3282 - protein, 4 aa, Brucella spp.
RPRS

SEQ ID NO: 3283 - protein, 9 aa, Brucella spp.
ERAERGDEA

SEQ ID NO: 3284 - protein, 15 aa, Brucella spp.
GTMPATPATAAQRRD

SEQ ID NO: 3285 - protein, 4 aa, Brucella spp.
GGTV

SEQ ID NO: 3286 - protein, 7 aa, Brucella spp.
GGRPSEA

SEQ ID NO: 3287 - protein, 9 aa, Brucella spp.
GPAGEDGSF

SEQ ID NO: 3288 - protein, 7 aa, Brucella spp.
FTPAAPA

SEQ ID NO: 3289 - protein, 6 aa, Brucella spp.
AGDGHV

SEQ ID NO: 3290 - protein, 35 aa, Brucella spp.
SQYGAQGAASSTKAETGTATPKGAALPASPSPEEL

SEQ ID NO: 3291 - protein, 4 aa, Brucella spp.
RAVS

SEQ ID NO: 3292 - protein, 8 aa, Brucella spp.
AEADGRAR

SEQ ID NO: 3293 - protein, 13 aa, Brucella spp.
RGRASHSDRQREP

SEQ ID NO: 3294 - protein, 8 aa, Brucella spp.
VVTEGGPV

SEQ ID NO: 3295 - protein, 6 aa, Brucella spp.
RGPTMD

SEQ ID NO: 3296 - protein, 7 aa, Brucella spp.
PKRFGVK

SEQ ID NO: 3297 - protein, 23 aa, Brucella spp.
LEERKIDGKRAWRAKDEITEPGA

SEQ ID NO: 3298 - protein, 5 aa, Brucella spp.
YWEPA

SEQ ID NO: 3299 - protein, 6 aa, Brucella spp.
ASGEDW

SEQ ID NO: 3300 - protein, 5 aa, Brucella spp.
TRPTG

SEQ ID NO: 3301 - protein, 8 aa, Brucella spp.
NGKPVPNA

SEQ ID NO: 3302 - protein, 9 aa, Brucella spp.
GSVKVPNPT

SEQ ID NO: 3303 - protein, 7 aa, Brucella spp.
ADSNGTF

SEQ ID NO: 3304 - protein, 17 aa, Brucella spp.
TEGDEKMKRPDGSLAPV

SEQ ID NO: 3305 - protein, 17 aa, Brucella spp.
MGPPALPHDASASAQFS

SEQ ID NO: 3306 - protein, 29 aa, Brucella spp.
NLEPHPHAPGRGSAGGGHNAKPDTTKPAS

SEQ ID NO: 3307 - protein, 4 aa, Brucella spp.
QERN

SEQ ID NO: 3308 - protein, 13 aa, Brucella spp.
GKLDRENPSGRLK

SEQ ID NO: 3309 - protein, 17 aa, Brucella spp.
LSPALAQDGGDKDDGVT

SEQ ID NO: 3310 - protein, 10 aa, Brucella spp.
SSLQRSTSSV

SEQ ID NO: 3311 - protein, 9 aa, Brucella spp.
IERSAAPDL

SEQ ID NO: 3312 - protein, 12 aa, Brucella spp.
VKTNGGQGSSAD

SEQ ID NO: 3313 - protein, 12 aa, Brucella spp.
RTASATSGSTAL

SEQ ID NO: 3314 - protein, 11 aa, Brucella spp.
GAHSSQYGADA

SEQ ID NO: 3315 - protein, 7 aa, Brucella spp.
QGGACGE

SEQ ID NO: 3316 - protein, 25 aa, Brucella spp.
STGVSHPWGGYASGSLQGRSSDGID

SEQ ID NO: 3317 - protein, 12 aa, Brucella spp.
FTGTQGYDFTTP

SEQ ID NO: 3318 - protein, 10 aa, Brucella spp.
FGHEPDDDGF

SEQ ID NO: 3319 - protein, 30 aa, Brucella spp.
RGRNQYDATAPAFNEADSTAFTGKVGTRID

SEQ ID NO: 3320 - protein, 16 aa, Brucella spp.
TGIDNSRNFRKGIEGS

SEQ ID NO: 3321 - protein, 9 aa, Brucella spp.
TEKSFDTGK

SEQ ID NO: 3322 - protein, 8 aa, Brucella spp.
DYDETGRD

SEQ ID NO: 3323 - protein, 5 aa, Brucella spp.
NGQFG

SEQ ID NO: 3324 - protein, 4 aa, Brucella spp.
YATG

SEQ ID NO: 3325 - protein, 13 aa, Brucella spp.
NPDLQPEKSRSVE

SEQ ID NO: 3326 - protein, 6 aa, Brucella spp.
ATASTS

SEQ ID NO: 3327 - protein, 6 aa, Brucella spp.
KVTGLE

SEQ ID NO: 3328 - protein, 14 aa, Brucella spp.
RPVDEDSGNDLPYR

SEQ ID NO: 3329 - protein, 16 aa, Brucella spp.
GSRYTNAKNTKKLGDY

SEQ ID NO: 3330 - protein, 5 aa, Brucella spp.
KQSQL

SEQ ID NO: 3331 - protein, 23 aa, Brucella spp.
DYETSSGYVAPGRTITIGLTRNF

SEQ ID NO: 3332 - protein, 7 aa, Brucella spp.
PANAADI

SEQ ID NO: 3333 - protein, 4 aa, Brucella spp.
GQLQ

SEQ ID NO: 3334 - protein, 5 aa, Brucella spp.
SRDPQ

SEQ ID NO: 3335 - protein, 4 aa, Brucella spp.
AERL

SEQ ID NO: 3336 - protein, 6 aa, Brucella spp.
FSSRAT

SEQ ID NO: 3337 - protein, 4 aa, Brucella spp.
PARS

SEQ ID NO: 3338 - protein, 10 aa, Brucella spp.
RQAEAQAQID

SEQ ID NO: 3339 - protein, 7 aa, Brucella spp.
KRPDHAK

SEQ ID NO: 3340 - protein, 9 aa, Brucella spp.
SYTSGQGTL

SEQ ID NO: 3341 - protein, 8 aa, Brucella spp.
SSRDRAPA

SEQ ID NO: 3342 - protein, 4 aa, Brucella spp.
QARA

SEQ ID NO: 3343 - protein, 4 aa, Brucella spp.
LSGA

SEQ ID NO: 3344 - protein, 5 aa, Brucella spp.
PLAEP

SEQ ID NO: 3345 - protein, 5 aa, Brucella spp.
ASASL

SEQ ID NO: 3346 - protein, 5 aa, Brucella spp.
GRNAG

SEQ ID NO: 3347 - protein, 5 aa, Brucella spp.
SPNPF

SEQ ID NO: 3348 - protein, 4 aa, Brucella spp.
DRSM

SEQ ID NO: 3349 - protein, 10 aa, Brucella spp.
TLGSDAAATM

SEQ ID NO: 3350 - protein, 7 aa, Brucella spp.
ASTAVAG

SEQ ID NO: 3351 - protein, 4 aa, Brucella spp.
ARPS

SEQ ID NO: 3352 - protein, 13 aa, Brucella spp.
RALADASFETKGG

SEQ ID NO: 3353 - protein, 9 aa, Brucella spp.
GPNGAGKTT

SEQ ID NO: 3354 - protein, 9 aa, Brucella spp.
ASSGQVSLA

SEQ ID NO: 3355 - protein, 7 aa, Brucella spp.
AAEKARS

SEQ ID NO: 3356 - protein, 4 aa, Brucella spp.
RQDE

SEQ ID NO: 3357 - protein, 6 aa, Brucella spp.
SGGERA

SEQ ID NO: 3358 - protein, 7 aa, Brucella spp.
PVAGLDP

SEQ ID NO: 3359 - protein, 5 aa, Brucella spp.
AREGR

SEQ ID NO: 3360 - protein, 8 aa, Brucella spp.
ADGTPAEV

SEQ ID NO: 3361 - protein, 7 aa, Brucella spp.
YPAQAAG

SEQ ID NO: 3362 - protein, 4 aa, Brucella spp.
SATQ

SEQ ID NO: 3363 - protein, 4 aa, Brucella spp.
APNE

SEQ ID NO: 3364 - protein, 8 aa, Brucella spp.
KAEGRKIP

SEQ ID NO: 3365 - protein, 7 aa, Brucella spp.
LPPHQRN

SEQ ID NO: 3366 - protein, 10 aa, Brucella spp.
EGSHGPKSSR

SEQ ID NO: 3367 - protein, 6 aa, Brucella spp.
FARRNR

SEQ ID NO: 3368 - protein, 8 aa, Brucella spp.
NDLRERTA

SEQ ID NO: 3369 - protein, 10 aa, Brucella spp.
GSRGENPLSD

SEQ ID NO: 3370 - protein, 5 aa, Brucella spp.
QQTAA

SEQ ID NO: 3371 - protein, 6 aa, Brucella spp.
EDEDKI

SEQ ID NO: 3372 - protein, 9 aa, Brucella spp.
EFPDEDEEV

SEQ ID NO: 3373 - protein, 10 aa, Brucella spp.
VAQSDGQGGY

SEQ ID NO: 3374 - protein, 8 aa, Brucella spp.
DEGDRYTT

SEQ ID NO: 3375 - protein, 7 aa, Brucella spp.
GGESFTA

SEQ ID NO: 3376 - protein, 6 aa, Brucella spp.
GPHTPG

SEQ ID NO: 3377 - protein, 5 aa, Brucella spp.
ALGTG

SEQ ID NO: 3378 - protein, 4 aa, Brucella spp.
TERG

SEQ ID NO: 3379 - protein, 11 aa, Brucella spp.
VTGRAQGMAAS

SEQ ID NO: 3380 - protein, 5 aa, Brucella spp.
QTGSR

SEQ ID NO: 3381 - protein, 12 aa, Brucella spp.
ELSHRAAEESLP

SEQ ID NO: 3382 - protein, 4 aa, Brucella spp.
PPAG

SEQ ID NO: 3383 - protein, 24 aa, Brucella spp.
RGATNLTADESNATEHNIAEPEPL

SEQ ID NO: 3384 - protein, 5 aa, Brucella spp.
GLQEK

SEQ ID NO: 3385 - protein, 15 aa, Brucella spp.
KGIETIAGNASNTEI

SEQ ID NO: 3386 - protein, 6 aa, Brucella spp.
ANPGVA

SEQ ID NO: 3387 - protein, 7 aa, Brucella spp.
GRAANSG

SEQ ID NO: 3388 - protein, 5 aa, Brucella spp.
QAEAQ

SEQ ID NO: 3389 - protein, 14 aa, Brucella spp.
IGADPRSERNEHVP

SEQ ID NO: 3390 - protein, 20 aa, Brucella spp.
VPAGPKENMPEKAEDTATDI

SEQ ID NO: 3391 - protein, 16 aa, Brucella spp.
VNENGGDMKREGMVIG

SEQ ID NO: 3392 - protein, 38 aa, Brucella spp.
SSQAGDALNQPRGIAARQAEGSAAAPARQQSTPAPQPI

SEQ ID NO: 3393 - protein, 9 aa, Brucella spp.
SGNRSAEAA

SEQ ID NO: 3394 - protein, 43 aa, Brucella spp.
AVAQNDKQQNPPASQSAPAEKPNGQAASAADQRPPEPVSSPVS

SEQ ID NO: 3395 - protein, 6 aa, Brucella spp.
QQRPTF

SEQ ID NO: 3396 - protein, 16 aa, Brucella spp.
KINEQLSKSASSDEAL

SEQ ID NO: 3397 - protein, 15 aa, Brucella spp.
LGPAPSSDQPAEPAI

SEQ ID NO: 3398 - protein, 13 aa, Brucella spp.
INATLGETEDTSL

SEQ ID NO: 3399 - protein, 6 aa, Brucella spp.
STLGSE

SEQ ID NO: 3400 - protein, 5 aa, Brucella spp.
SAASD

SEQ ID NO: 3401 - protein, 10 aa, Brucella spp.
RDPSVESPSY

SEQ ID NO: 3402 - protein, 5 aa, Brucella spp.
APRPG

SEQ ID NO: 3403 - protein, 5 aa, Brucella spp.
ALTSG

SEQ ID NO: 3404 - protein, 9 aa, Brucella spp.
EREKDGAVR

SEQ ID NO: 3405 - protein, 15 aa, Brucella spp.
AISEEQAFASSRIGK

SEQ ID NO: 3406 - protein, 10 aa, Brucella spp.
GRVDSGVRNS

SEQ ID NO: 3407 - protein, 4 aa, Brucella spp.
VETF

SEQ ID NO: 3408 - protein, 6 aa, Brucella spp.
FTEDPR

SEQ ID NO: 3409 - protein, 4 aa, Brucella spp.
NPEP

SEQ ID NO: 3410 - protein, 8 aa, Brucella spp.
ITSTGSIK

SEQ ID NO: 3411 - protein, 8 aa, Brucella spp.
SLSSSSTD

SEQ ID NO: 3412 - protein, 5 aa, Brucella spp.
PDVEK

SEQ ID NO: 3413 - protein, 28 aa, Brucella spp.
EEKGLSAAASREKTGEKKPEEGDKDDRA

SEQ ID NO: 3414 - protein, 12 aa, Brucella spp.
AKLSNNDSGPQT

SEQ ID NO: 3415 - protein, 6 aa, Brucella spp.
EGASKR

SEQ ID NO: 3416 - protein, 6 aa, Brucella spp.
NGDRAA

SEQ ID NO: 3417 - protein, 5 aa, Brucella spp.
SDVGK

SEQ ID NO: 3418 - protein, 21 aa, Brucella spp.
FKPQNMSNNAAVSDDGGEIGR

SEQ ID NO: 3419 - protein, 6 aa, Brucella spp.
PQTDMG

SEQ ID NO: 3420 - protein, 10 aa, Brucella spp.
VRGEARGRYY

SEQ ID NO: 3421 - protein, 6 aa, Brucella spp.
KVGDGA

SEQ ID NO: 3422 - protein, 8 aa, Brucella spp.
GAGSPAEI

SEQ ID NO: 3423 - protein, 6 aa, Brucella spp.
RLPAED

SEQ ID NO: 3424 - protein, 5 aa, Brucella spp.
VRGDK

SEQ ID NO: 3425 - protein, 7 aa, Brucella spp.
PLKAEPA

SEQ ID NO: 3426 - protein, 9 aa, Brucella spp.
PGSSLPADA

SEQ ID NO: 3427 - protein, 6 aa, Brucella spp.
GTKSTI

SEQ ID NO: 3428 - protein, 9 aa, Brucella spp.
SDPAGIEGN

SEQ ID NO: 3429 - protein, 5 aa, Brucella spp.
MTEPE

SEQ ID NO: 3430 - protein, 8 aa, Brucella spp.
RTSGPDMA

SEQ ID NO: 3431 - protein, 13 aa, Brucella spp.
GDHDDGAVSPDGR

SEQ ID NO: 3432 - protein, 6 aa, Brucella spp.
EGGQMN

SEQ ID NO: 3433 - protein, 36 aa, Brucella spp.
TYEDAAGGHHHGEAEVAPHDHAAPAAEARDEEGAEL

SEQ ID NO: 3434 - protein, 6 aa, Brucella spp.
PELPAM

SEQ ID NO: 3435 - protein, 13 aa, Brucella spp.
APHPEDISSPVPS

SEQ ID NO: 3436 - protein, 12 aa, Brucella spp.
GARSGKSSYAEK

SEQ ID NO: 3437 - protein, 5 aa, Brucella spp.
FDTEM

SEQ ID NO: 3438 - protein, 7 aa, Brucella spp.
ERRGPQW

SEQ ID NO: 3439 - protein, 4 aa, Brucella spp.
HAAA

SEQ ID NO: 3440 - protein, 5 aa, Brucella spp.
SGKTT

SEQ ID NO: 3441 - protein, 5 aa, Brucella spp.
NANGK

SEQ ID NO: 3442 - protein, 7 aa, Brucella spp.
DREDRPD

SEQ ID NO: 3443 - protein, 27 aa, Brucella spp.
AEGRFADDHDKVDAQRAADESLDHESP

SEQ ID NO: 3444 - protein, 14 aa, Brucella spp.
DSVKADVAERSSRR

SEQ ID NO: 3445 - protein, 6 aa, Brucella spp.
GTEDDI

SEQ ID NO: 3446 - protein, 14 aa, Brucella spp.
HEAHHGDGHEHDHD

SEQ ID NO: 3447 - protein, 10 aa, Brucella spp.
GSVADPKAFA

SEQ ID NO: 3448 - protein, 8 aa, Brucella spp.
GKDETRST

SEQ ID NO: 3449 - protein, 14 aa, Brucella spp.
SDGNEAVDLGQTPG

SEQ ID NO: 3450 - protein, 5 aa, Brucella spp.
DTELA

SEQ ID NO: 3451 - protein, 11 aa, Brucella spp.
LPGDDKPDHGL

SEQ ID NO: 3452 - protein, 7 aa, Brucella spp.
IPAGERD

SEQ ID NO: 3453 - protein, 6 aa, Brucella spp.
GAANTH

SEQ ID NO: 3454 - protein, 9 aa, Brucella spp.
CEKPEAAAP

SEQ ID NO: 3455 - protein, 4 aa, Brucella spp.
SSLT

SEQ ID NO: 3456 - protein, 5 aa, Brucella spp.
DPAAP

SEQ ID NO: 3457 - protein, 7 aa, Brucella spp.
SGQTQPV

SEQ ID NO: 3458 - protein, 4 aa, Brucella spp.
DPLS

SEQ ID NO: 3459 - protein, 14 aa, Brucella spp.
ISSPGAERKPTVLD

SEQ ID NO: 3460 - protein, 6 aa, Brucella spp.
GTPKTV

SEQ ID NO: 3461 - protein, 7 aa, Brucella spp.
SAQQFDA

SEQ ID NO: 3462 - protein, 5 aa, Brucella spp.
EPHPD

SEQ ID NO: 3463 - protein, 7 aa, Brucella spp.
RKPPAER

SEQ ID NO: 3464 - protein, 10 aa, Brucella spp.
PNRDGRLGNG

SEQ ID NO: 3465 - protein, 8 aa, Brucella spp.
GLDTPAGT

SEQ ID NO: 3466 - protein, 7 aa, Brucella spp.
EIPADSD

SEQ ID NO: 3467 - protein, 13 aa, Brucella spp.
GPTNAARDGREIR

SEQ ID NO: 3468 - protein, 9 aa, Brucella spp.
WGAPENDPY

SEQ ID NO: 3469 - protein, 12 aa, Brucella spp.
ARGYNIDPKETY

SEQ ID NO: 3470 - protein, 13 aa, Brucella spp.
DPGEGTQAKRRAS

SEQ ID NO: 3471 - protein, 12 aa, Brucella spp.
PPLTRAESYGPL

SEQ ID NO: 3472 - protein, 8 aa, Brucella spp.
EASGVDPR

SEQ ID NO: 3473 - protein, 10 aa, Brucella spp.
GIHDHDDEDM

SEQ ID NO: 3474 - protein, 10 aa, Brucella spp.
GGAPGDQSLQ

SEQ ID NO: 3475 - protein, 9 aa, Brucella spp.
ADAGLGEGF

SEQ ID NO: 3476 - protein, 7 aa, Brucella spp.
PWAGAKP

SEQ ID NO: 3477 - protein, 5 aa, Brucella spp.
GPSEI

SEQ ID NO: 3478 - protein, 18 aa, Brucella spp.
VPPGPSGAPTRGRPDVLP

SEQ ID NO: 3479 - protein, 8 aa, Brucella spp.
SRAVPTPA

SEQ ID NO: 3480 - protein, 8 aa, Brucella spp.
QDHGEWPT

SEQ ID NO: 3481 - protein, 10 aa, Brucella spp.
SNMRTGGDDI

SEQ ID NO: 3482 - protein, 6 aa, Brucella spp.
KLARPR

SEQ ID NO: 3483 - protein, 9 aa, Brucella spp.
EDVEDNPIA

SEQ ID NO: 3484 - protein, 12 aa, Brucella spp.
GGADPQTAERRA

SEQ ID NO: 3485 - protein, 8 aa, Brucella spp.
SKPGAYGA

SEQ ID NO: 3486 - protein, 8 aa, Brucella spp.
NGWAGRND

SEQ ID NO: 3487 - protein, 12 aa, Brucella spp.
YGAGEEGQAERG

SEQ ID NO: 3488 - protein, 9 aa, Brucella spp.
QNQDNREHD

SEQ ID NO: 3489 - protein, 8 aa, Brucella spp.
DHSRPEKP

SEQ ID NO: 3490 - protein, 7 aa, Brucella spp.
GRAANPK

SEQ ID NO: 3491 - protein, 6 aa, Brucella spp.
KGAAEI

SEQ ID NO: 3492 - protein, 6 aa, Brucella spp.
TTGKVG

SEQ ID NO: 3493 - protein, 16 aa, Brucella spp.
KNPAALAETAAKLNEA

SEQ ID NO: 3494 - protein, 9 aa, Brucella spp.
TPRSNSARF

SEQ ID NO: 3495 - protein, 28 aa, Brucella spp.
ELNARHADKMRKKKAARDKIQATKTEEK

SEQ ID NO: 3496 - protein, 10 aa, Brucella spp.
GKGKGKSTAG

SEQ ID NO: 3497 - protein, 6 aa, Brucella spp.
SWDTGE

SEQ ID NO: 3498 - protein, 7 aa, Brucella spp.
TQDRARD

SEQ ID NO: 3499 - protein, 4 aa, Brucella spp.
AKPE

SEQ ID NO: 3500 - protein, 7 aa, Brucella spp.
RNAKDEL

SEQ ID NO: 3501 - protein, 13 aa, Brucella spp.
NAVQRVAEDPALA

SEQ ID NO: 3502 - protein, 7 aa, Brucella spp.
GNQHPAE

SEQ ID NO: 3503 - protein, 8 aa, Brucella spp.
GIPPEELP

SEQ ID NO: 3504 - protein, 9 aa, Brucella spp.
YETTTKQAA

SEQ ID NO: 3505 - protein, 8 aa, Brucella spp.
RLDRSETT

SEQ ID NO: 3506 - protein, 4 aa, Brucella spp.
KPEE

SEQ ID NO: 3507 - protein, 24 aa, Brucella spp.
ALTKGGCSRPDGIATLSTKRGNPA

SEQ ID NO: 3508 - protein, 16 aa, Brucella spp.
LEDETPRLNSPSQETF

SEQ ID NO: 3509 - protein, 8 aa, Brucella spp.
LAAAGPNG

SEQ ID NO: 3510 - protein, 17 aa, Brucella spp.
ASARSTAALAMVPTFPL

SEQ ID NO: 3511 - protein, 9 aa, Brucella spp.
AGAPKNARL

SEQ ID NO: 3512 - protein, 7 aa, Brucella spp.
HSGDSSI

SEQ ID NO: 3513 - protein, 4 aa, Brucella spp.
PGVP

SEQ ID NO: 3514 - protein, 11 aa, Brucella spp.
MKSSAMPEGED

SEQ ID NO: 3515 - protein, 7 aa, Brucella spp.
ALGKSGA

SEQ ID NO: 3516 - protein, 7 aa, Brucella spp.
IEASGLR

SEQ ID NO: 3517 - protein, 6 aa, Brucella spp.
DPKNFR

SEQ ID NO: 3518 - protein, 7 aa, Brucella spp.
TAEAASL

SEQ ID NO: 3519 - protein, 24 aa, Brucella spp.
AGRTAAPAKLSGPVRSGGFGGADG

SEQ ID NO: 3520 - protein, 4 aa, Brucella spp.
TEAT

SEQ ID NO: 3521 - protein, 7 aa, Brucella spp.
EKQPGDN

SEQ ID NO: 3522 - protein, 13 aa, Brucella spp.
NETEAARAIPPGE

SEQ ID NO: 3523 - protein, 4 aa, Brucella spp.
PEVT

SEQ ID NO: 3524 - protein, 7 aa, Brucella spp.
PGDYDAE

SEQ ID NO: 3525 - protein, 8 aa, Brucella spp.
RNSGGTVS

SEQ ID NO: 3526 - protein, 4 aa, Brucella spp.
PVAA

SEQ ID NO: 3527 - protein, 5 aa, Brucella spp.
PEKAE

SEQ ID NO: 3528 - protein, 9 aa, Brucella spp.
CATAATKAA

SEQ ID NO: 3529 - protein, 11 aa, Brucella spp.
DAGDDPDVTHG

SEQ ID NO: 3530 - protein, 7 aa, Brucella spp.
PAPPGTG

SEQ ID NO: 3531 - protein, 8 aa, Brucella spp.
EGVGTVTR

SEQ ID NO: 3532 - protein, 10 aa, Brucella spp.
AIPPPGEAAI

SEQ ID NO: 3533 - protein, 11 aa, Brucella spp.
PGGEEIAQKTW

SEQ ID NO: 3534 - protein, 6 aa, Brucella spp.
RAAGQK

SEQ ID NO: 3535 - protein, 12 aa, Brucella spp.
GATGSTSEDAAQ

SEQ ID NO: 3536 - protein, 7 aa, Brucella spp.
SSRSQVD

SEQ ID NO: 3537 - protein, 8 aa, Brucella spp.
RAGAPADM

SEQ ID NO: 3538 - protein, 7 aa, Brucella spp.
GSGKTTV

SEQ ID NO: 3539 - protein, 7 aa, Brucella spp.
KAGPDYI

SEQ ID NO: 3540 - protein, 8 aa, Brucella spp.
SRMTESGA

SEQ ID NO: 3541 - protein, 10 aa, Brucella spp.
IDGKGSSADL

SEQ ID NO: 3542 - protein, 5 aa, Brucella spp.
GSPRH

SEQ ID NO: 3543 - protein, 7 aa, Brucella spp.
PRDPALS

SEQ ID NO: 3544 - protein, 5 aa, Brucella spp.
DEHAG

SEQ ID NO: 3545 - protein, 10 aa, Brucella spp.
ADEAPKADAD

SEQ ID NO: 3546 - protein, 4 aa, Brucella spp.
GASR

SEQ ID NO: 3547 - protein, 7 aa, Brucella spp.
DAAARGV

SEQ ID NO: 3548 - protein, 5 aa, Brucella spp.
LEDAA

SEQ ID NO: 3549 - protein, 5 aa, Brucella spp.
REEKA

SEQ ID NO: 3550 - protein, 9 aa, Brucella spp.
ASGENLGEA

SEQ ID NO: 3551 - protein, 6 aa, Brucella spp.
FGGSAQ

SEQ ID NO: 3552 - protein, 4 aa, Brucella spp.
GINP

SEQ ID NO: 3553 - protein, 6 aa, Brucella spp.
AAPGTQ

SEQ ID NO: 3554 - protein, 6 aa, Brucella spp.
DIPAGA

SEQ ID NO: 3555 - protein, 8 aa, Brucella spp.
PNNPDGRV

SEQ ID NO: 3556 - protein, 4 aa, Brucella spp.
LGER

SEQ ID NO: 3557 - protein, 5 aa, Brucella spp.
TEVGG

SEQ ID NO: 3558 - protein, 16 aa, Brucella spp.
GEKNFNDSSLPPSTLR

SEQ ID NO: 3559 - protein, 6 aa, Brucella spp.
AGTAGA

SEQ ID NO: 3560 - protein, 10 aa, Brucella spp.
RDDGIEGGRK

SEQ ID NO: 3561 - protein, 13 aa, Brucella spp.
NPDRLDEGGVSRA

SEQ ID NO: 3562 - protein, 9 aa, Brucella spp.
LAENASDGI

SEQ ID NO: 3563 - protein, 10 aa, Brucella spp.
LGHGREAGRQ

SEQ ID NO: 3564 - protein, 10 aa, Brucella spp.
HRSPNAGWPE

SEQ ID NO: 3565 - protein, 12 aa, Brucella spp.
GPRQYGAETVEG

SEQ ID NO: 3566 - protein, 12 aa, Brucella spp.
ATGKREAEARDI

SEQ ID NO: 3567 - protein, 7 aa, Brucella spp.
ALAQAED

SEQ ID NO: 3568 - protein, 5 aa, Brucella spp.
PLSGT

SEQ ID NO: 3569 - protein, 4 aa, Brucella spp.
FAPL

SEQ ID NO: 3570 - protein, 9 aa, Brucella spp.
GARAAAGTG

SEQ ID NO: 3571 - protein, 12 aa, Brucella spp.
CDAEGGKEAAER

SEQ ID NO: 3572 - protein, 8 aa, Brucella spp.
RRAASPLP

SEQ ID NO: 3573 - protein, 10 aa, Brucella spp.
LNKETQATGS

SEQ ID NO: 3574 - protein, 8 aa, Brucella spp.
TIEGRERA

SEQ ID NO: 3575 - protein, 8 aa, Brucella spp.
YRPGLDKQ

SEQ ID NO: 3576 - protein, 4 aa, Brucella spp.
RAGA

SEQ ID NO: 3577 - protein, 6 aa, Brucella spp.
GERDDI

SEQ ID NO: 3578 - protein, 5 aa, Brucella spp.
GASAA

SEQ ID NO: 3579 - protein, 9 aa, Brucella spp.
AAPGPHPLA

SEQ ID NO: 3580 - protein, 11 aa, Brucella spp.
PSDLSTAKPAI

SEQ ID NO: 3581 - protein, 4 aa, Brucella spp.
DKLA

SEQ ID NO: 3582 - protein, 10 aa, Brucella spp.
IKRTDEQKQP

SEQ ID NO: 3583 - protein, 4 aa, Brucella spp.
SFET

SEQ ID NO: 3584 - protein, 13 aa, Brucella spp.
NGIRTDNPNRLQR

SEQ ID NO: 3585 - protein, 20 aa, Brucella spp.
TVPTSTATPGKTEAPVSAPT

SEQ ID NO: 3586 - protein, 10 aa, Brucella spp.
NSRPGAGGGM

SEQ ID NO: 3587 - protein, 5 aa, Brucella spp.
SSGGV

SEQ ID NO: 3588 - protein, 42 aa, Brucella spp.
DTSPKSADQIAAEEAAAKADAAAAAQPKKAAAKKKKRFNNRC

SEQ ID NO: 3589 - protein, 6 aa, Brucella spp.
LPTTRQ

SEQ ID NO: 3590 - protein, 7 aa, Brucella spp.
VSTADKT

SEQ ID NO: 3591 - protein, 5 aa, Brucella spp.
EDGSA

SEQ ID NO: 3592 - protein, 7 aa, Brucella spp.
AITTSGE

SEQ ID NO: 3593 - protein, 4 aa, Brucella spp.
PPSD

SEQ ID NO: 3594 - protein, 11 aa, Brucella spp.
LANPDDAKTFT

SEQ ID NO: 3595 - protein, 7 aa, Brucella spp.
LNGKSNW

SEQ ID NO: 3596 - protein, 5 aa, Brucella spp.
PFADD

SEQ ID NO: 3597 - protein, 8 aa, Brucella spp.
HNRTPRTN

SEQ ID NO: 3598 - protein, 11 aa, Brucella spp.
ETPDESLQGQI

SEQ ID NO: 3599 - protein, 7 aa, Brucella spp.
GAGLAKT

SEQ ID NO: 3600 - protein, 4 aa, Brucella spp.
DCTS

SEQ ID NO: 3601 - protein, 7 aa, Brucella spp.
GAPDARE

SEQ ID NO: 3602 - protein, 4 aa, Brucella spp.
KAPA

SEQ ID NO: 3603 - protein, 5 aa, Brucella spp.
GPGAR

SEQ ID NO: 3604 - protein, 4 aa, Brucella spp.
ELEQ

SEQ ID NO: 3605 - protein, 5 aa, Brucella spp.
PFRTG

SEQ ID NO: 3606 - protein, 7 aa, Brucella spp.
NREEMQR

SEQ ID NO: 3607 - protein, 6 aa, Brucella spp.
SSGDPG

SEQ ID NO: 3608 - protein, 7 aa, Brucella spp.
ESDNPAW

SEQ ID NO: 3609 - protein, 6 aa, Brucella spp.
SRIGAP

SEQ ID NO: 3610 - protein, 7 aa, Brucella spp.
KARPHQL

SEQ ID NO: 3611 - protein, 6 aa, Brucella spp.
RSGETP

SEQ ID NO: 3612 - protein, 9 aa, Brucella spp.
IGRAGETTR

SEQ ID NO: 3613 - protein, 5 aa, Brucella spp.
TPGDV

SEQ ID NO: 3614 - protein, 11 aa, Brucella spp.
TRRFAQPDGGE

SEQ ID NO: 3615 - protein, 7 aa, Brucella spp.
VGPGDPE

SEQ ID NO: 3616 - protein, 9 aa, Brucella spp.
ARGKKGNAF

SEQ ID NO: 3617 - protein, 4 aa, Brucella spp.
EKLP

SEQ ID NO: 3618 - protein, 5 aa, Brucella spp.
LDQGQ

SEQ ID NO: 3619 - protein, 6 aa, Brucella spp.
LAQTEA

SEQ ID NO: 3620 - protein, 5 aa, Brucella spp.
NGSDC

SEQ ID NO: 3621 - protein, 12 aa, Brucella spp.
FSEGAGKAGRNA

SEQ ID NO: 3622 - protein, 7 aa, Brucella spp.
RSRLPAD

SEQ ID NO: 3623 - protein, 7 aa, Brucella spp.
DPSVPEL

SEQ ID NO: 3624 - protein, 9 aa, Brucella spp.
KIGNTRSAA

SEQ ID NO: 3625 - protein, 7 aa, Brucella spp.
AGAPKPA

SEQ ID NO: 3626 - protein, 14 aa, Brucella spp.
AAESKDELAANSRG

SEQ ID NO: 3627 - protein, 8 aa, Brucella spp.
RRGGSAMT

SEQ ID NO: 3628 - protein, 7 aa, Brucella spp.
DRRSACP

SEQ ID NO: 3629 - protein, 6 aa, Brucella spp.
EHSGAR

SEQ ID NO: 3630 - protein, 11 aa, Brucella spp.
LGADNPAADDI

SEQ ID NO: 3631 - protein, 8 aa, Brucella spp.
PTAGIDPG

SEQ ID NO: 3632 - protein, 6 aa, Brucella spp.
VDGGED

SEQ ID NO: 3633 - protein, 5 aa, Brucella spp.
TEEGK

SEQ ID NO: 3634 - protein, 8 aa, Brucella spp.
SSPDRQAL

SEQ ID NO: 3635 - protein, 4 aa, Brucella spp.
TSER

SEQ ID NO: 3636 - protein, 8 aa, Brucella spp.
APGETDRI

SEQ ID NO: 3637 - protein, 13 aa, Brucella spp.
TGLETSPKSAHAR

SEQ ID NO: 3638 - protein, 7 aa, Brucella spp.
SGATGCA

SEQ ID NO: 3639 - protein, 9 aa, Brucella spp.
LADTQADGN

SEQ ID NO: 3640 - protein, 8 aa, Brucella spp.
LESGSDPV

SEQ ID NO: 3641 - protein, 4 aa, Brucella spp.
SAGR

SEQ ID NO: 3642 - protein, 12 aa, Brucella spp.
RFSQNGAGPSRF

SEQ ID NO: 3643 - protein, 16 aa, Brucella spp.
EDGLDGLGQAARNAIA

SEQ ID NO: 3644 - protein, 7 aa, Brucella spp.
NDTEAER

SEQ ID NO: 3645 - protein, 4 aa, Brucella spp.
RRGR

SEQ ID NO: 3646 - protein, 9 aa, Brucella spp.
NDGTTPARV

SEQ ID NO: 3647 - protein, 10 aa, Brucella spp.
GGPKERTLHG

SEQ ID NO: 3648 - protein, 17 aa, Brucella spp.
AGLPDEAFENDGQLTKR

SEQ ID NO: 3649 - protein, 8 aa, Brucella spp.
ADEGRQGM

SEQ ID NO: 3650 - protein, 11 aa, Brucella spp.
GRAPSALRGLE

SEQ ID NO: 3651 - protein, 5 aa, Brucella spp.
VTDEG

SEQ ID NO: 3652 - protein, 6 aa, Brucella spp.
KPGGRL

SEQ ID NO: 3653 - protein, 6 aa, Brucella spp.
QAGELG

SEQ ID NO: 3654 - protein, 5 aa, Brucella spp.
EFPGF

SEQ ID NO: 3655 - protein, 16 aa, Brucella spp.
LQRTPKLEKPHYAGHR

SEQ ID NO: 3656 - protein, 8 aa, Brucella spp.
FRDAPDAL

SEQ ID NO: 3657 - protein, 7 aa, Brucella spp.
ADTKPIA

SEQ ID NO: 3658 - protein, 7 aa, Brucella spp.
PGAGPTV

SEQ ID NO: 3659 - protein, 8 aa, Brucella spp.
KRSARSTV

SEQ ID NO: 3660 - protein, 9 aa, Brucella spp.
VQQTGTVDH

SEQ ID NO: 3661 - protein, 11 aa, Brucella spp.
PSGDPTPSRAD

SEQ ID NO: 3662 - protein, 4 aa, Brucella spp.
VKYT

SEQ ID NO: 3663 - protein, 7 aa, Brucella spp.
PGVTTNE

SEQ ID NO: 3664 - protein, 9 aa, Brucella spp.
GYTKSTCTS

SEQ ID NO: 3665 - protein, 9 aa, Brucella spp.
PNDKPLREG

SEQ ID NO: 3666 - protein, 5 aa, Brucella spp.
GDSSR

SEQ ID NO: 3667 - protein, 5 aa, Brucella spp.
KRASE

SEQ ID NO: 3668 - protein, 11 aa, Brucella spp.
VKPGAKTGAIG

SEQ ID NO: 3669 - protein, 8 aa, Brucella spp.
TYAESERC

SEQ ID NO: 3670 - protein, 8 aa, Brucella spp.
GTPNEGVE

SEQ ID NO: 3671 - protein, 8 aa, Brucella spp.
RDRSLTAQ

SEQ ID NO: 3672 - protein, 6 aa, Brucella spp.
VPNTGS

SEQ ID NO: 3673 - protein, 5 aa, Brucella spp.
TAPGS

SEQ ID NO: 3674 - protein, 7 aa, Brucella spp.
DAPHRKY

SEQ ID NO: 3675 - protein, 5 aa, Brucella spp.
GLPNR

SEQ ID NO: 3676 - protein, 9 aa, Brucella spp.
REQKYGRNS

SEQ ID NO: 3677 - protein, 7 aa, Brucella spp.
DGPRPRA

SEQ ID NO: 3678 - protein, 9 aa, Brucella spp.
DTVTARGAK

SEQ ID NO: 3679 - protein, 5 aa, Brucella spp.
NGIDA

SEQ ID NO: 3680 - protein, 18 aa, Brucella spp.
GGKEFQGTPQEGASRTGV

SEQ ID NO: 3681 - protein, 64 aa, Brucella spp.
KAATAQITPEEKQQLTTTLDADRTRLAPQKAPGGGFTAAEAQAMRRQAQEQTNATLKQIESGQE

SEQ ID NO: 3682 - protein, 9 aa, Brucella spp.
ASPPSPAHG

SEQ ID NO: 3683 - protein, 7 aa, Brucella spp.
QSATGQK

SEQ ID NO: 3684 - protein, 8 aa, Brucella spp.
LGPREANT

SEQ ID NO: 3685 - protein, 10 aa, Brucella spp.
GVSVEGAPEF

SEQ ID NO: 3686 - protein, 16 aa, Brucella spp.
PDPATLNDMDNAAGRI

SEQ ID NO: 3687 - protein, 5 aa, Brucella spp.
DGACS

SEQ ID NO: 3688 - protein, 9 aa, Brucella spp.
GYGPNPDAM

SEQ ID NO: 3689 - protein, 17 aa, Brucella spp.
GTNSVPSITAAKQAGAD

SEQ ID NO: 3690 - protein, 7 aa, Brucella spp.
GGDLPED

SEQ ID NO: 3691 - protein, 11 aa, Brucella spp.
NPNREDDISQQ

SEQ ID NO: 3692 - protein, 10 aa, Brucella spp.
ARGKGPGPDL

SEQ ID NO: 3693 - protein, 6 aa, Brucella spp.
RGQSNV

SEQ ID NO: 3694 - protein, 11 aa, Brucella spp.
NAGGRIGDAGL

SEQ ID NO: 3695 - protein, 6 aa, Brucella spp.
NQERQA

SEQ ID NO: 3696 - protein, 12 aa, Brucella spp.
EASLEISGGAGA

SEQ ID NO: 3697 - protein, 8 aa, Brucella spp.
KEKARRPA

SEQ ID NO: 3698 - protein, 13 aa, Brucella spp.
NGVGSGSGRSISG

SEQ ID NO: 3699 - protein, 4 aa, Brucella spp.
GGHA

SEQ ID NO: 3700 - protein, 6 aa, Brucella spp.
ENQSLS

SEQ ID NO: 3701 - protein, 7 aa, Brucella spp.
LAASGAT

SEQ ID NO: 3702 - protein, 12 aa, Brucella spp.
KAGPYGSAHPQP

SEQ ID NO: 3703 - protein, 4 aa, Brucella spp.
GVGR

SEQ ID NO: 3704 - protein, 8 aa, Brucella spp.
RGADGKRV

SEQ ID NO: 3705 - protein, 4 aa, Brucella spp.
AEGD

SEQ ID NO: 3706 - protein, 15 aa, Brucella spp.
SVSPQIQILDAALPV

SEQ ID NO: 3707 - protein, 8 aa, Brucella spp.
SQHASEEL

SEQ ID NO: 3708 - protein, 4 aa, Brucella spp.
QPGL

SEQ ID NO: 3709 - protein, 6 aa, Brucella spp.
AQMPPQ

SEQ ID NO: 3710 - protein, 7 aa, Brucella spp.
VTPSSGL

SEQ ID NO: 3711 - protein, 6 aa, Brucella spp.
RGEGTE

SEQ ID NO: 3712 - protein, 5 aa, Brucella spp.
TGEKG

SEQ ID NO: 3713 - protein, 7 aa, Brucella spp.
ADEAQPM

SEQ ID NO: 3714 - protein, 5 aa, Brucella spp.
STGNK

SEQ ID NO: 3715 - protein, 6 aa, Brucella spp.
DTDEAR

SEQ ID NO: 3716 - protein, 4 aa, Brucella spp.
SEVP

SEQ ID NO: 3717 - protein, 7 aa, Brucella spp.
VKRTGIK

SEQ ID NO: 3718 - protein, 7 aa, Brucella spp.
QAGEGDP

SEQ ID NO: 3719 - protein, 24 aa, Brucella spp.
RGHGFSTKSHKAEDYTPSKMAGDA

SEQ ID NO: 3720 - protein, 6 aa, Brucella spp.
GDWEPI

SEQ ID NO: 3721 - protein, 9 aa, Brucella spp.
EDPATITHP

SEQ ID NO: 3722 - protein, 7 aa, Brucella spp.
DQTRSDR

SEQ ID NO: 3723 - protein, 11 aa, Brucella spp.
TTDDIAGSAQE

SEQ ID NO: 3724 - protein, 4 aa, Brucella spp.
PNGE

SEQ ID NO: 3725 - protein, 5 aa, Brucella spp.
LDIPG

SEQ ID NO: 3726 - protein, 5 aa, Brucella spp.
NAGLD

SEQ ID NO: 3727 - protein, 10 aa, Brucella spp.
EAEEATRNDP

SEQ ID NO: 3728 - protein, 4 aa, Brucella spp.
QPSL

SEQ ID NO: 3729 - protein, 5 aa, Brucella spp.
GHPDV

SEQ ID NO: 3730 - protein, 7 aa, Brucella spp.
DRDPAYS

SEQ ID NO: 3731 - protein, 4 aa, Brucella spp.
SSSI

SEQ ID NO: 3732 - protein, 15 aa, Brucella spp.
LGGTGKSSGDRHPKI

SEQ ID NO: 3733 - protein, 18 aa, Brucella spp.
TGCTEPSRVMDQMLGDGI

SEQ ID NO: 3734 - protein, 6 aa, Brucella spp.
QFADRE

SEQ ID NO: 3735 - protein, 8 aa, Brucella spp.
GDNEPITI

SEQ ID NO: 3736 - protein, 7 aa, Brucella spp.
DTNVQEQ

SEQ ID NO: 3737 - protein, 4 aa, Brucella spp.
MEIP

SEQ ID NO: 3738 - protein, 4 aa, Brucella spp.
EKLR

SEQ ID NO: 3739 - protein, 5 aa, Brucella spp.
GGREP

SEQ ID NO: 3740 - protein, 5 aa, Brucella spp.
SPLAG

SEQ ID NO: 3741 - protein, 5 aa, Brucella spp.
SGAIS

SEQ ID NO: 3742 - protein, 8 aa, Brucella spp.
YGRRSEFA

SEQ ID NO: 3743 - protein, 8 aa, Brucella spp.
YSTGGADF

SEQ ID NO: 3744 - protein, 18 aa, Brucella spp.
KRTMTDQNSPRTPKDSHY

SEQ ID NO: 3745 - protein, 23 aa, Brucella spp.
QHRDQKAGAEGKSPRKPQRPAIA

SEQ ID NO: 3746 - protein, 6 aa, Brucella spp.
AVAEGT

SEQ ID NO: 3747 - protein, 6 aa, Brucella spp.
VENPQR

SEQ ID NO: 3748 - protein, 13 aa, Brucella spp.
PRDIDKETGSEAV

SEQ ID NO: 3749 - protein, 4 aa, Brucella spp.
PLRT

SEQ ID NO: 3750 - protein, 4 aa, Brucella spp.
ELRE

SEQ ID NO: 3751 - protein, 5 aa, Brucella spp.
TDPHN

SEQ ID NO: 3752 - protein, 9 aa, Brucella spp.
SHHSPQETG

SEQ ID NO: 3753 - protein, 6 aa, Brucella spp.
KAASGA

SEQ ID NO: 3754 - protein, 7 aa, Brucella spp.
DSQGPLE

SEQ ID NO: 3755 - protein, 4 aa, Brucella spp.
LSGN

SEQ ID NO: 3756 - protein, 13 aa, Brucella spp.
EGKGLRQKTRETV

SEQ ID NO: 3757 - protein, 14 aa, Brucella spp.
AEDIEAKAKQKGLS

SEQ ID NO: 3758 - protein, 7 aa, Brucella spp.
GRKVDAE

SEQ ID NO: 3759 - protein, 5 aa, Brucella spp.
TPKVT

SEQ ID NO: 3760 - protein, 9 aa, Brucella spp.
SKPVPVSQK

SEQ ID NO: 3761 - protein, 10 aa, Brucella spp.
DGVERPKTSV

SEQ ID NO: 3762 - protein, 7 aa, Brucella spp.
VSDGPFA

SEQ ID NO: 3763 - protein, 7 aa, Brucella spp.
VDEERAR

SEQ ID NO: 3764 - protein, 18 aa, Brucella spp.
PAGAANPSPPIGPALGQR

SEQ ID NO: 3765 - protein, 12 aa, Brucella spp.
AASQEMEKGSPI

SEQ ID NO: 3766 - protein, 20 aa, Brucella spp.
ANLKSGSKTPGKASAGTITR

SEQ ID NO: 3767 - protein, 5 aa, Brucella spp.
NAADV

SEQ ID NO: 3768 - protein, 4 aa, Brucella spp.
EGVD

SEQ ID NO: 3769 - protein, 5 aa, Brucella spp.
DPRHA

SEQ ID NO: 3770 - protein, 7 aa, Brucella spp.
PNGTGRT

SEQ ID NO: 3771 - protein, 15 aa, Brucella spp.
GDKAEEAKKAGADIV

SEQ ID NO: 3772 - protein, 10 aa, Brucella spp.
PNPKVGTVTT

SEQ ID NO: 3773 - protein, 9 aa, Brucella spp.
VAASKGGAV

SEQ ID NO: 3774 - protein, 5 aa, Brucella spp.
KLEEN

SEQ ID NO: 3775 - protein, 10 aa, Brucella spp.
AKPSAAKGEY

SEQ ID NO: 3776 - protein, 6 aa, Brucella spp.
FKESGS

SEQ ID NO: 3777 - protein, 12 aa, Brucella spp.
SKMRDAGGSVKV

SEQ ID NO: 3778 - protein, 9 aa, Brucella spp.
LQGTESEGI

SEQ ID NO: 3779 - protein, 7 aa, Brucella spp.
NDPITAP

SEQ ID NO: 3780 - protein, 12 aa, Brucella spp.
GATTLNADGVKS

SEQ ID NO: 3781 - protein, 6 aa, Brucella spp.
ASLPSL

SEQ ID NO: 3782 - protein, 7 aa, Brucella spp.
SAPAGQI

SEQ ID NO: 3783 - protein, 11 aa, Brucella spp.
EPSGGRPDEGL

SEQ ID NO: 3784 - protein, 13 aa, Brucella spp.
EDTGAKSIKDIKE

SEQ ID NO: 3785 - protein, 8 aa, Brucella spp.
KGKTHSSG

SEQ ID NO: 3786 - protein, 5 aa, Brucella spp.
RKLPA

SEQ ID NO: 3787 - protein, 7 aa, Brucella spp.
TYTRDGD

SEQ ID NO: 3788 - protein, 5 aa, Brucella spp.
ADTGE

SEQ ID NO: 3789 - protein, 16 aa, Brucella spp.
KKLTARAAKQLAEKGL

SEQ ID NO: 3790 - protein, 8 aa, Brucella spp.
AIKATEDD

SEQ ID NO: 3791 - protein, 6 aa, Brucella spp.
GDEIDE

SEQ ID NO: 3792 - protein, 6 aa, Brucella spp.
DTGETE

SEQ ID NO: 3793 - protein, 8 aa, Brucella spp.
DKNESRQE

SEQ ID NO: 3794 - protein, 9 aa, Brucella spp.
PGEPPTMDS

SEQ ID NO: 3795 - protein, 4 aa, Brucella spp.
AEDT

SEQ ID NO: 3796 - protein, 7 aa, Brucella spp.
DGRGEID

SEQ ID NO: 3797 - protein, 7 aa, Brucella spp.
NLGNRRV

SEQ ID NO: 3798 - protein, 7 aa, Brucella spp.
AKPAAAA

SEQ ID NO: 3799 - protein, 7 aa, Brucella spp.
TNPLSEI

SEQ ID NO: 3800 - protein, 13 aa, Brucella spp.
ALGPGGLTRERAG

SEQ ID NO: 3801 - protein, 8 aa, Brucella spp.
ETPEGPNI

SEQ ID NO: 3802 - protein, 4 aa, Brucella spp.
GKVT

SEQ ID NO: 3803 - protein, 7 aa, Brucella spp.
AKHSVAQ

SEQ ID NO: 3804 - protein, 6 aa, Brucella spp.
LDEQGG

SEQ ID NO: 3805 - protein, 7 aa, Brucella spp.
DDANRAL

SEQ ID NO: 3806 - protein, 11 aa, Brucella spp.
DSGAAIAARRG

SEQ ID NO: 3807 - protein, 10 aa, Brucella spp.
EELDPSKSGV

SEQ ID NO: 3808 - protein, 9 aa, Brucella spp.
QRSNQSTCI

SEQ ID NO: 3809 - protein, 9 aa, Brucella spp.
ADGPSTDLG

SEQ ID NO: 3810 - protein, 11 aa, Brucella spp.
RDTKLGPEEIT

SEQ ID NO: 3811 - protein, 7 aa, Brucella spp.
PNVSEEA

SEQ ID NO: 3812 - protein, 13 aa, Brucella spp.
ITPKGESPMTPEE

SEQ ID NO: 3813 - protein, 9 aa, Brucella spp.
KASDVRDTS

SEQ ID NO: 3814 - protein, 8 aa, Brucella spp.
RMPPGTYG

SEQ ID NO: 3815 - protein, 7 aa, Brucella spp.
VEKDERA

SEQ ID NO: 3816 - protein, 9 aa, Brucella spp.
AKDRDDEQA

SEQ ID NO: 3817 - protein, 16 aa, Brucella spp.
VAAAGPKGFKKGTTIT

SEQ ID NO: 3818 - protein, 7 aa, Brucella spp.
EKLQGEL

SEQ ID NO: 3819 - protein, 8 aa, Brucella spp.
RSQYDDSK

SEQ ID NO: 3820 - protein, 11 aa, Brucella spp.
KVQRGDEMPPG

SEQ ID NO: 3821 - protein, 16 aa, Brucella spp.
KIQPGDKMAGRHGNKG

SEQ ID NO: 3822 - protein, 6 aa, Brucella spp.
ANIEPL

SEQ ID NO: 3823 - protein, 13 aa, Brucella spp.
PDNDRNEPVRSYD

SEQ ID NO: 3824 - protein, 20 aa, Brucella spp.
GLATSGQSTLYDGRTGEPFD

SEQ ID NO: 3825 - protein, 14 aa, Brucella spp.
QQPLGGKAQFGGQR

SEQ ID NO: 3826 - protein, 9 aa, Brucella spp.
SDDVAGRTK

SEQ ID NO: 3827 - protein, 8 aa, Brucella spp.
DDTFEAGI

SEQ ID NO: 3828 - protein, 16 aa, Brucella spp.
DDTREAEQPALPDAAE

SEQ ID NO: 3829 - protein, 7 aa, Brucella spp.
QAPAQTF

SEQ ID NO: 3830 - protein, 8 aa, Brucella spp.
IKKPETIN

SEQ ID NO: 3831 - protein, 6 aa, Brucella spp.
FKPERD

SEQ ID NO: 3832 - protein, 4 aa, Brucella spp.
PSRI

SEQ ID NO: 3833 - protein, 5 aa, Brucella spp.
PGLTS

SEQ ID NO: 3834 - protein, 9 aa, Brucella spp.
AETTSDLKQ

SEQ ID NO: 3835 - protein, 5 aa, Brucella spp.
SGNRP

SEQ ID NO: 3836 - protein, 7 aa, Brucella spp.
GRFATSD

SEQ ID NO: 3837 - protein, 8 aa, Brucella spp.
NGRRGRVI

SEQ ID NO: 3838 - protein, 9 aa, Brucella spp.
GANKRPLKS

SEQ ID NO: 3839 - protein, 6 aa, Brucella spp.
GKQGRF

SEQ ID NO: 3840 - protein, 5 aa, Brucella spp.
VDYSG

SEQ ID NO: 3841 - protein, 11 aa, Brucella spp.
AKGYSSTVKQA

SEQ ID NO: 3842 - protein, 6 aa, Brucella spp.
VEKERP

SEQ ID NO: 3843 - protein, 4 aa, Brucella spp.
FDGD

SEQ ID NO: 3844 - protein, 7 aa, Brucella spp.
EKEPGEG

SEQ ID NO: 3845 - protein, 9 aa, Brucella spp.
VDAEGNPVS

SEQ ID NO: 3846 - protein, 6 aa, Brucella spp.
YDTTPG

SEQ ID NO: 3847 - protein, 5 aa, Brucella spp.
MTKKN

SEQ ID NO: 3848 - protein, 12 aa, Brucella spp.
EALTTEYEQQYN

SEQ ID NO: 3849 - protein, 6 aa, Brucella spp.
TQGEKY

SEQ ID NO: 3850 - protein, 9 aa, Brucella spp.
GKATDKITE

SEQ ID NO: 3851 - protein, 10 aa, Brucella spp.
DPVTGRQKQM

SEQ ID NO: 3852 - protein, 8 aa, Brucella spp.
SGARGSVN

SEQ ID NO: 3853 - protein, 6 aa, Brucella spp.
KPSGEI

SEQ ID NO: 3854 - protein, 22 aa, Brucella spp.
STHGARKGLADTALKTANSGYL

SEQ ID NO: 3855 - protein, 4 aa, Brucella spp.
ETRN

SEQ ID NO: 3856 - protein, 12 aa, Brucella spp.
LARGTPVNQGEA

SEQ ID NO: 3857 - protein, 8 aa, Brucella spp.
SIGEPGTQ

SEQ ID NO: 3858 - protein, 6 aa, Brucella spp.
ASYEGT

SEQ ID NO: 3859 - protein, 6 aa, Brucella spp.
VRNSDG

SEQ ID NO: 3860 - protein, 6 aa, Brucella spp.
TGKERA

SEQ ID NO: 3861 - protein, 9 aa, Brucella spp.
GDTVKRGQR

SEQ ID NO: 3862 - protein, 12 aa, Brucella spp.
VSETADESTGIT

SEQ ID NO: 3863 - protein, 9 aa, Brucella spp.
STPRGSDLK

SEQ ID NO: 3864 - protein, 6 aa, Brucella spp.
SKGGDA

SEQ ID NO: 3865 - protein, 5 aa, Brucella spp.
PGAHV

SEQ ID NO: 3866 - protein, 13 aa, Brucella spp.
ESAKTKDITGGLP

SEQ ID NO: 3867 - protein, 6 aa, Brucella spp.
ARRPKD

SEQ ID NO: 3868 - protein, 5 aa, Brucella spp.
RDYKN

SEQ ID NO: 3869 - protein, 6 aa, Brucella spp.
NDDTIE

SEQ ID NO: 3870 - protein, 7 aa, Brucella spp.
GNPAPHD

SEQ ID NO: 3871 - protein, 12 aa, Brucella spp.
ITESGDTGYIPG

SEQ ID NO: 3872 - protein, 10 aa, Brucella spp.
EGKKPGSGNP

SEQ ID NO: 3873 - protein, 7 aa, Brucella spp.
ASLQTPS

SEQ ID NO: 3874 - protein, 5 aa, Brucella spp.
FQETT

SEQ ID NO: 3875 - protein, 8 aa, Brucella spp.
AGTGGMTN

SEQ ID NO: 3876 - protein, 11 aa, Brucella spp.
RRKTSGSAEAN

SEQ ID NO: 3877 - protein, 7 aa, Brucella spp.
INPDPKF

SEQ ID NO: 3878 - protein, 5 aa, Brucella spp.
KSVAE

SEQ ID NO: 3879 - protein, 8 aa, Brucella spp.
EATAKSEP

SEQ ID NO: 3880 - protein, 8 aa, Brucella spp.
RRVGGATY

SEQ ID NO: 3881 - protein, 6 aa, Brucella spp.
RPERRQ

SEQ ID NO: 3882 - protein, 8 aa, Brucella spp.
ARGRNETT

SEQ ID NO: 3883 - protein, 18 aa, Brucella spp.
ANNRGSAVKKREDTHRMA

SEQ ID NO: 3884 - protein, 6 aa, Brucella spp.
GKTTMT

SEQ ID NO: 3885 - protein, 12 aa, Brucella spp.
HKIGETHDGAST

SEQ ID NO: 3886 - protein, 7 aa, Brucella spp.
EQERGIT

SEQ ID NO: 3887 - protein, 5 aa, Brucella spp.
SAATT

SEQ ID NO: 3888 - protein, 8 aa, Brucella spp.
GRDGKKRR

SEQ ID NO: 3889 - protein, 9 aa, Brucella spp.
AGVEPQTET

SEQ ID NO: 3890 - protein, 10 aa, Brucella spp.
IGAPATVGEI

SEQ ID NO: 3891 - protein, 8 aa, Brucella spp.
ADKAEEYR

SEQ ID NO: 3892 - protein, 7 aa, Brucella spp.
TMPTNDE

SEQ ID NO: 3893 - protein, 6 aa, Brucella spp.
APTDVP

SEQ ID NO: 3894 - protein, 17 aa, Brucella spp.
VKTETETTRESSDEAPL

SEQ ID NO: 3895 - protein, 7 aa, Brucella spp.
LTKGVSL

SEQ ID NO: 3896 - protein, 11 aa, Brucella spp.
ENTVKGKRERI

SEQ ID NO: 3897 - protein, 8 aa, Brucella spp.
NSREDIDE

SEQ ID NO: 3898 - protein, 9 aa, Brucella spp.
KETTTGDTL

SEQ ID NO: 3899 - protein, 10 aa, Brucella spp.
PKTKADQEKM

SEQ ID NO: 3900 - protein, 7 aa, Brucella spp.
AEDPSFR

SEQ ID NO: 3901 - protein, 10 aa, Brucella spp.
VKSDEESGQT

SEQ ID NO: 3902 - protein, 7 aa, Brucella spp.
NVGAPQV

SEQ ID NO: 3903 - protein, 11 aa, Brucella spp.
HKKQSGGSGQF

SEQ ID NO: 3904 - protein, 9 aa, Brucella spp.
GGSVPKEYI

SEQ ID NO: 3905 - protein, 11 aa, Brucella spp.
FREGAQKAGAQ

SEQ ID NO: 3906 - protein, 15 aa, Brucella spp.
NSRRGQISGTEARGI

SEQ ID NO: 3907 - protein, 8 aa, Brucella spp.
SMSQGRAQ

SEQ ID NO: 3908 - protein, 4 aa, Brucella spp.
TREI

SEQ ID NO: 3909 - protein, 16 aa, Brucella spp.
TAKRTGANVRGPIPLP

SEQ ID NO: 3910 - protein, 13 aa, Brucella spp.
RSPHIDKKSREQF

SEQ ID NO: 3911 - protein, 6 aa, Brucella spp.
PTPQTV

SEQ ID NO: 3912 - protein, 9 aa, Brucella spp.
VKNTSKAMR

SEQ ID NO: 3913 - protein, 7 aa, Brucella spp.
EVEPKAK

SEQ ID NO: 3914 - protein, 10 aa, Brucella spp.
DVTGTSIGKG

SEQ ID NO: 3915 - protein, 29 aa, Brucella spp.
GGHRASHGNSITHRSHGSTGQRQDPGKVF

SEQ ID NO: 3916 - protein, 6 aa, Brucella spp.
TRVTTQ

SEQ ID NO: 3917 - protein, 6 aa, Brucella spp.
STDSDR

SEQ ID NO: 3918 - protein, 7 aa, Brucella spp.
AVPGSKG

SEQ ID NO: 3919 - protein, 28 aa, Brucella spp.
ASLPENAPKPAGLRAGAKAEAAATEGGE

SEQ ID NO: 3920 - protein, 6 aa, Brucella spp.
DAGKVK

SEQ ID NO: 3921 - protein, 49 aa, Brucella spp.
RQQGSHKAQGRGDVSRTGSKMYKQKGTGRARHHSARAPQFRGGGQAHGP

SEQ ID NO: 3922 - protein, 5 aa, Brucella spp.
HDLPK

SEQ ID NO: 3923 - protein, 7 aa, Brucella spp.
SAKAKAS

SEQ ID NO: 3924 - protein, 10 aa, Brucella spp.
ASADAKTKQL

SEQ ID NO: 3925 - protein, 6 aa, Brucella spp.
AAGSGH

SEQ ID NO: 3926 - protein, 17 aa, Brucella spp.
HPSPRQARSFQGGCRSP

SEQ ID NO: 3927 - protein, 5 aa, Brucella spp.
STMVS

SEQ ID NO: 3928 - protein, 8 aa, Brucella spp.
KATKPEIK

SEQ ID NO: 3929 - protein, 5 aa, Brucella spp.
RQSDV

SEQ ID NO: 3930 - protein, 25 aa, Brucella spp.
LYKGKPVKSLTEGLSKKGGRNNTGR

SEQ ID NO: 3931 - protein, 7 aa, Brucella spp.
GGGHKRS

SEQ ID NO: 3932 - protein, 6 aa, Brucella spp.
EYDPNR

SEQ ID NO: 3933 - protein, 13 aa, Brucella spp.
AGNSVDVKPGNAM

SEQ ID NO: 3934 - protein, 14 aa, Brucella spp.
PGKGGQIARSAGTY

SEQ ID NO: 3935 - protein, 6 aa, Brucella spp.
SGEQRL

SEQ ID NO: 3936 - protein, 19 aa, Brucella spp.
VSNPDHGNINDGKAGRSVW

SEQ ID NO: 3937 - protein, 5 aa, Brucella spp.
KRPHV

SEQ ID NO: 3938 - protein, 36 aa, Brucella spp.
HPHGGGEGRTSGGRHPVTPWGKPTKGKKTRSNKATD

SEQ ID NO: 3939 - protein, 5 aa, Brucella spp.
NTGEY

SEQ ID NO: 3940 - protein, 7 aa, Brucella spp.
KGADIEK

SEQ ID NO: 3941 - protein, 10 aa, Brucella spp.
LSEMTNADTS

SEQ ID NO: 3942 - protein, 5 aa, Brucella spp.
KPEVD

SEQ ID NO: 3943 - protein, 5 aa, Brucella spp.
RLGGA

SEQ ID NO: 3944 - protein, 11 aa, Brucella spp.
DYGTAEAKTAY

SEQ ID NO: 3945 - protein, 24 aa, Brucella spp.
MASERRAVEGDNQGSSSNRRRENA

SEQ ID NO: 3946 - protein, 11 aa, Brucella spp.
IHGNSKGGTDL

SEQ ID NO: 3947 - protein, 6 aa, Brucella spp.
EPERVT

SEQ ID NO: 3948 - protein, 17 aa, Brucella spp.
VTSKPTEVRMGKGKGSV

SEQ ID NO: 3949 - protein, 6 aa, Brucella spp.
VPEDVA

SEQ ID NO: 3950 - protein, 6 aa, Brucella spp.
DNSGAR

SEQ ID NO: 3951 - protein, 8 aa, Brucella spp.
GSKRRYAS

SEQ ID NO: 3952 - protein, 12 aa, Brucella spp.
AIPRGRVKKGDV

SEQ ID NO: 3953 - protein, 8 aa, Brucella spp.
KDIRRPDG

SEQ ID NO: 3954 - protein, 7 aa, Brucella spp.
KKEPIGT

SEQ ID NO: 3955 - protein, 9 aa, Brucella spp.
GKDKGRKGE

SEQ ID NO: 3956 - protein, 5 aa, Brucella spp.
KDEQA

SEQ ID NO: 3957 - protein, 10 aa, Brucella spp.
QRQTQTQEAG

SEQ ID NO: 3958 - protein, 11 aa, Brucella spp.
ADPKDGKPTRV

SEQ ID NO: 3959 - protein, 17 aa, Brucella spp.
DGKKVRVAKRSGALIDG

SEQ ID NO: 3960 - protein, 14 aa, Brucella spp.
GEATGDSKKPAVAA

SEQ ID NO: 3961 - protein, 5 aa, Brucella spp.
VTRAR

SEQ ID NO: 3962 - protein, 11 aa, Brucella spp.
NPKSFDGRGNY

SEQ ID NO: 3963 - protein, 9 aa, Brucella spp.
AKTDDEARS

SEQ ID NO: 3964 - protein, 15 aa, Brucella spp.
VGRKKTKVSTPASKL

SEQ ID NO: 3965 - protein, 10 aa, Brucella spp.
QSEFENGKAE

SEQ ID NO: 3966 - protein, 7 aa, Brucella spp.
VSKPGRR

SEQ ID NO: 3967 - protein, 5 aa, Brucella spp.
TPKGV

SEQ ID NO: 3968 - protein, 16 aa, Brucella spp.
EAREQNVGGELLCRIF

SEQ ID NO: 3969 - protein, 17 aa, Brucella spp.
TASVEGQTVKAKGAKGE

SEQ ID NO: 3970 - protein, 16 aa, Brucella spp.
VRVDPRDQSREARSKW

SEQ ID NO: 3971 - protein, 4 aa, Brucella spp.
PKPT

SEQ ID NO: 3972 - protein, 6 aa, Brucella spp.
KQQVGQ

SEQ ID NO: 3973 - protein, 17 aa, Brucella spp.
EYRGPEPYKGKGVKYAG

SEQ ID NO: 3974 - protein, 7 aa, Brucella spp.
VANGRPR

SEQ ID NO: 3975 - protein, 4 aa, Brucella spp.
SSKN

SEQ ID NO: 3976 - protein, 24 aa, Brucella spp.
ASTLDGDLKGKLKTGADSAAAAAV

SEQ ID NO: 3977 - protein, 4 aa, Brucella spp.
VKAG

SEQ ID NO: 3978 - protein, 8 aa, Brucella spp.
GREERDSE

SEQ ID NO: 3979 - protein, 5 aa, Brucella spp.
KGGRR

SEQ ID NO: 3980 - protein, 8 aa, Brucella spp.
DQKGRVGF

SEQ ID NO: 3981 - protein, 7 aa, Brucella spp.
KAREVPE

SEQ ID NO: 3982 - protein, 7 aa, Brucella spp.
KATEAAK

SEQ ID NO: 3983 - protein, 7 aa, Brucella spp.
EGRHGAG

SEQ ID NO: 3984 - protein, 8 aa, Brucella spp.
AAPAGKGI

SEQ ID NO: 3985 - protein, 8 aa, Brucella spp.
SLGSSNPY

SEQ ID NO: 3986 - protein, 5 aa, Brucella spp.
AAQRG

SEQ ID NO: 3987 - protein, 34 aa, Brucella spp.
SVKARKRVGRGIGSGTGKTGGRGVKGQKSRSGVS

SEQ ID NO: 3988 - protein, 4 aa, Brucella spp.
GFEG

SEQ ID NO: 3989 - protein, 5 aa, Brucella spp.
AGKLD

SEQ ID NO: 3990 - protein, 25 aa, Brucella spp.
GASKAAVEKIEKAGGSIKLPEAAAE

SEQ ID NO: 3991 - protein, 5 aa, Brucella spp.
KAEEL

SEQ ID NO: 3992 - protein, 5 aa, Brucella spp.
INPDA

SEQ ID NO: 3993 - protein, 9 aa, Brucella spp.
KKEGEAGRK

SEQ ID NO: 3994 - protein, 10 aa, Brucella spp.
QSGNGIVTNP

SEQ ID NO: 3995 - protein, 5 aa, Brucella spp.
ARGIG

SEQ ID NO: 3996 - protein, 7 aa, Brucella spp.
GRTGALS

SEQ ID NO: 3997 - protein, 4 aa, Brucella spp.
KRQV

SEQ ID NO: 3998 - protein, 6 aa, Brucella spp.
ANTTEM

SEQ ID NO: 3999 - protein, 9 aa, Brucella spp.
PKDTADQLK

SEQ ID NO: 4000 - protein, 8 aa, Brucella spp.
RPGERTAE

SEQ ID NO: 4001 - protein, 8 aa, Brucella spp.
GKGTQAGL

SEQ ID NO: 4002 - protein, 6 aa, Brucella spp.
GIPQLS

SEQ ID NO: 4003 - protein, 10 aa, Brucella spp.
QQSEIGKRAK

SEQ ID NO: 4004 - protein, 6 aa, Brucella spp.
IDAPDC

SEQ ID NO: 4005 - protein, 7 aa, Brucella spp.
PRTVPQA

SEQ ID NO: 4006 - protein, 18 aa, Brucella spp.
ETIAKGAQVRSDDNPEAF

SEQ ID NO: 4007 - protein, 14 aa, Brucella spp.
EKTAPLSSYYAGTG

SEQ ID NO: 4008 - protein, 9 aa, Brucella spp.
ADDRRVNQL

SEQ ID NO: 4009 - protein, 6 aa, Brucella spp.
YQVEGD

SEQ ID NO: 4010 - protein, 25 aa, Brucella spp.
VRGQRTHTNARTRKGPAKAIAGKKK

SEQ ID NO: 4011 - protein, 8 aa, Brucella spp.
ERKNISSG

SEQ ID NO: 4012 - protein, 6 aa, Brucella spp.
DAQGNA

SEQ ID NO: 4013 - protein, 18 aa, Brucella spp.
SSAGAQGFKGSRKSTPFA

SEQ ID NO: 4014 - protein, 12 aa, Brucella spp.
EDCAKKAQEHGM

SEQ ID NO: 4015 - protein, 10 aa, Brucella spp.
GPGSGRESAL

SEQ ID NO: 4016 - protein, 5 aa, Brucella spp.
SRTHA

SEQ ID NO: 4017 - protein, 5 aa, Brucella spp.
PGVRE

SEQ ID NO: 4018 - protein, 7 aa, Brucella spp.
EGEGPKR

SEQ ID NO: 4019 - protein, 7 aa, Brucella spp.
EGPGVVT

SEQ ID NO: 4020 - protein, 5 aa, Brucella spp.
DIQTV

SEQ ID NO: 4021 - protein, 9 aa, Brucella spp.
TGKGYVPAD

SEQ ID NO: 4022 - protein, 8 aa, Brucella spp.
CNRAEDAP

SEQ ID NO: 4023 - protein, 8 aa, Brucella spp.
IENTREGQ

SEQ ID NO: 4024 - protein, 10 aa, Brucella spp.
TNGSVTGEDA

SEQ ID NO: 4025 - protein, 11 aa, Brucella spp.
EPQKEAPQEQV

SEQ ID NO: 4026 - protein, 8 aa, Brucella spp.
PNFGRKSL

SEQ ID NO: 4027 - protein, 5 aa, Brucella spp.
PPENI

SEQ ID NO: 4028 - protein, 6 aa, Brucella spp.
RTASHR

SEQ ID NO: 4029 - protein, 6 aa, Brucella spp.
KAKEIR

SEQ ID NO: 4030 - protein, 8 aa, Brucella spp.
GKRGDLHA

SEQ ID NO: 4031 - protein, 7 aa, Brucella spp.
YATRNGG

SEQ ID NO: 4032 - protein, 7 aa, Brucella spp.
RAGDNAP

SEQ ID NO: 4033 - protein, 23 aa, Brucella spp.
VDAKGKADRARVEAEAAAEADAA

SEQ ID NO: 4034 - protein, 13 aa, Brucella spp.
GPVAAQDSPATAV

SEQ ID NO: 4035 - protein, 5 aa, Brucella spp.
ETAPA

SEQ ID NO: 4036 - protein, 9 aa, Brucella spp.
QARSPFEGD

SEQ ID NO: 4037 - protein, 11 aa, Brucella spp.
GASKPRIQQSL

SEQ ID NO: 4038 - protein, 5 aa, Brucella spp.
DGREF

SEQ ID NO: 4039 - protein, 4 aa, Brucella spp.
ETTD

SEQ ID NO: 4040 - protein, 6 aa, Brucella spp.
NSDEVE

SEQ ID NO: 4041 - protein, 6 aa, Brucella spp.
QTVTSG

SEQ ID NO: 4042 - protein, 9 aa, Brucella spp.
SAQSRTQVG

SEQ ID NO: 4043 - protein, 10 aa, Brucella spp.
AINPGNSGGA

SEQ ID NO: 4044 - protein, 8 aa, Brucella spp.
YSRSGGSV

SEQ ID NO: 4045 - protein, 7 aa, Brucella spp.
LQGSTRF

SEQ ID NO: 4046 - protein, 4 aa, Brucella spp.
MEKP

SEQ ID NO: 4047 - protein, 10 aa, Brucella spp.
KDGPAETAGL

SEQ ID NO: 4048 - protein, 5 aa, Brucella spp.
AGIGK

SEQ ID NO: 4049 - protein, 13 aa, Brucella spp.
KAPKVKQAEPKVI

SEQ ID NO: 4050 - protein, 9 aa, Brucella spp.
EGDNPFDGA

SEQ ID NO: 4051 - protein, 9 aa, Brucella spp.
DLTASTAAK

SEQ ID NO: 4052 - protein, 6 aa, Brucella spp.
KRGQQG

SEQ ID NO: 4053 - protein, 9 aa, Brucella spp.
SGSPAARLG

SEQ ID NO: 4054 - protein, 5 aa, Brucella spp.
GNQIR

SEQ ID NO: 4055 - protein, 20 aa, Brucella spp.
TTDPYTGQQKVSNTTGGAAI

SEQ ID NO: 4056 - protein, 8 aa, Brucella spp.
GSSRAQRN

SEQ ID NO: 4057 - protein, 5 aa, Brucella spp.
QEAEL

SEQ ID NO: 4058 - protein, 12 aa, Brucella spp.
LQGTGVSVTRNG

SEQ ID NO: 4059 - protein, 8 aa, Brucella spp.
DTDQDQVK

SEQ ID NO: 4060 - protein, 20 aa, Brucella spp.
TDSTGSASYNQALSQRRAAS

SEQ ID NO: 4061 - protein, 7 aa, Brucella spp.
DSQGIDP

SEQ ID NO: 4062 - protein, 19 aa, Brucella spp.
ASQPIASNATPEGRAQNRR

SEQ ID NO: 4063 - protein, 6 aa, Brucella spp.
VSTGSL

SEQ ID NO: 4064 - protein, 5 aa, Brucella spp.
GLPKG

SEQ ID NO: 4065 - protein, 9 aa, Brucella spp.
GPESSGKTT

SEQ ID NO: 4066 - protein, 7 aa, Brucella spp.
EAQKKGG

SEQ ID NO: 4067 - protein, 8 aa, Brucella spp.
QPDTGEQA

SEQ ID NO: 4068 - protein, 18 aa, Brucella spp.
LTPRAEIEGEMGDSLPGL

SEQ ID NO: 4069 - protein, 6 aa, Brucella spp.
TGSISR

SEQ ID NO: 4070 - protein, 10 aa, Brucella spp.
SPETTTGGNA

SEQ ID NO: 4071 - protein, 12 aa, Brucella spp.
IKERDEVVGNQT

SEQ ID NO: 4072 - protein, 5 aa, Brucella spp.
LAPPF

SEQ ID NO: 4073 - protein, 4 aa, Brucella spp.
VVEK

SEQ ID NO: 4074 - protein, 22 aa, Brucella spp.
QRLGQGRENAKQYLKDNPEVAR

SEQ ID NO: 4075 - protein, 4 aa, Brucella spp.
TTLR

SEQ ID NO: 4076 - protein, 15 aa, Brucella spp.
DDGGPEEDAAGAAEM

SEQ ID NO: 4077 - protein, 6 aa, Brucella spp.
HEVVPS

SEQ ID NO: 4078 - protein, 7 aa, Brucella spp.
PLVPRND

SEQ ID NO: 4079 - protein, 23 aa, Brucella spp.
SYNRATTSQKCVRAGGKHNDLDN

SEQ ID NO: 4080 - protein, 5 aa, Brucella spp.
DDDAA

SEQ ID NO: 4081 - protein, 4 aa, Brucella spp.
GLSD

SEQ ID NO: 4082 - protein, 6 aa, Brucella spp.
TGPCGP

SEQ ID NO: 4083 - protein, 13 aa, Brucella spp.
GGPPGSPEEDGDR

SEQ ID NO: 4084 - protein, 4 aa, Brucella spp.
QTPE

SEQ ID NO: 4085 - protein, 6 aa, Brucella spp.
RPSIDT

SEQ ID NO: 4086 - protein, 15 aa, Brucella spp.
ASEEATGVKAEGDFR

SEQ ID NO: 4087 - protein, 8 aa, Brucella spp.
LPSNEGRG

SEQ ID NO: 4088 - protein, 16 aa, Brucella spp.
DASENLAEGDRLDGET

SEQ ID NO: 4089 - protein, 19 aa, Brucella spp.
RQKAEARANWTGSGEAATE

SEQ ID NO: 4090 - protein, 4 aa, Brucella spp.
VGAT

SEQ ID NO: 4091 - protein, 7 aa, Brucella spp.
ETESAEG

SEQ ID NO: 4092 - protein, 8 aa, Brucella spp.
PSVREGET

SEQ ID NO: 4093 - protein, 18 aa, Brucella spp.
PFYGESGGQQGDTGTISG

SEQ ID NO: 4094 - protein, 8 aa, Brucella spp.
DTQKKGEG

SEQ ID NO: 4095 - protein, 11 aa, Brucella spp.
VTEGTAKAGDV

SEQ ID NO: 4096 - protein, 13 aa, Brucella spp.
SARRTRIRSNHSA

SEQ ID NO: 4097 - protein, 5 aa, Brucella spp.
GSLVA

SEQ ID NO: 4098 - protein, 8 aa, Brucella spp.
PKPISAEE

SEQ ID NO: 4099 - protein, 4 aa, Brucella spp.
YGDE

SEQ ID NO: 4100 - protein, 13 aa, Brucella spp.
TAKHGSKAGKAYS

SEQ ID NO: 4101 - protein, 7 aa, Brucella spp.
HVRQTGD

SEQ ID NO: 4102 - protein, 5 aa, Brucella spp.
GGVAA

SEQ ID NO: 4103 - protein, 6 aa, Brucella spp.
EQDERV

SEQ ID NO: 4104 - protein, 8 aa, Brucella spp.
ALKTTSAD

SEQ ID NO: 4105 - protein, 9 aa, Brucella spp.
KLERELADA

SEQ ID NO: 4106 - protein, 16 aa, Brucella spp.
LALGGGSSDGGSAVEA

SEQ ID NO: 4107 - protein, 20 aa, Brucella spp.
GVSPRDLKPLADEGKKQVGS

SEQ ID NO: 4108 - protein, 9 aa, Brucella spp.
EDGKASAVA

SEQ ID NO: 4109 - protein, 38 aa, Brucella spp.
SAALGGAGGGGRPDMAQAGGPDGAKAADAIAAVKALIA

SEQ ID NO: 4110 - protein, 11 aa, Brucella spp.
ENRDATNDQVT

SEQ ID NO: 4111 - protein, 9 aa, Brucella spp.
TITPDEARV

SEQ ID NO: 4112 - protein, 7 aa, Brucella spp.
KSPNGTI

SEQ ID NO: 4113 - protein, 6 aa, Brucella spp.
FPGKGT

SEQ ID NO: 4114 - protein, 6 aa, Brucella spp.
EDGQTI

SEQ ID NO: 4115 - protein, 6 aa, Brucella spp.
QAPSAG

SEQ ID NO: 4116 - protein, 4 aa, Brucella spp.
SKFE

SEQ ID NO: 4117 - protein, 7 aa, Brucella spp.
YDGDVQS

SEQ ID NO: 4118 - protein, 15 aa, Brucella spp.
PDGKTVEAEAAHGTV

SEQ ID NO: 4119 - protein, 13 aa, Brucella spp.
QHQKGEETSTNSI

SEQ ID NO: 4120 - protein, 7 aa, Brucella spp.
KLDNNAD

SEQ ID NO: 4121 - protein, 4 aa, Brucella spp.
ARDN

SEQ ID NO: 4122 - protein, 10 aa, Brucella spp.
DESRNEGHDL

SEQ ID NO: 4123 - protein, 10 aa, Brucella spp.
PTEKTTPISA

SEQ ID NO: 4124 - protein, 26 aa, Brucella spp.
EQENYRQQRASWKKSAAGTDAAHRAA

SEQ ID NO: 4125 - protein, 18 aa, Brucella spp.
REEFPSEKARAAASKADH

SEQ ID NO: 4126 - protein, 11 aa, Brucella spp.
TARERDGFKPV

SEQ ID NO: 4127 - protein, 5 aa, Brucella spp.
MEAGN

SEQ ID NO: 4128 - protein, 7 aa, Brucella spp.
FKTGEKT

SEQ ID NO: 4129 - protein, 4 aa, Brucella spp.
EEVG

SEQ ID NO: 4130 - protein, 8 aa, Brucella spp.
GLENQTDT

SEQ ID NO: 4131 - protein, 4 aa, Brucella spp.
LAPK

SEQ ID NO: 4132 - protein, 24 aa, Brucella spp.
PKKPRGSGAPEGRARKPVNEDKAE

SEQ ID NO: 4133 - protein, 7 aa, Brucella spp.
KPTIAPE

SEQ ID NO: 4134 - protein, 4 aa, Brucella spp.
GFPY

SEQ ID NO: 4135 - protein, 11 aa, Brucella spp.
IKPAAERTSSG

SEQ ID NO: 4136 - protein, 8 aa, Brucella spp.
TPGTVKRA

SEQ ID NO: 4137 - protein, 4 aa, Brucella spp.
RGES

SEQ ID NO: 4138 - protein, 7 aa, Brucella spp.
KDGKRTD

SEQ ID NO: 4139 - protein, 12 aa, Brucella spp.
PARSDDDEFHSQ

SEQ ID NO: 4140 - protein, 6 aa, Brucella spp.
RKPDYA

SEQ ID NO: 4141 - protein, 9 aa, Brucella spp.
TGGTAGTYY

SEQ ID NO: 4142 - protein, 11 aa, Brucella spp.
ISGAGEKGVPG

SEQ ID NO: 4143 - protein, 8 aa, Brucella spp.
VSSNGSVA

SEQ ID NO: 4144 - protein, 11 aa, Brucella spp.
SGALESGFTQS

SEQ ID NO: 4145 - protein, 11 aa, Brucella spp.
TGLYDGKGKVE

SEQ ID NO: 4146 - protein, 7 aa, Brucella spp.
DANIKSV

SEQ ID NO: 4147 - protein, 17 aa, Brucella spp.
DLKGKRVSLDEPGSGTI

SEQ ID NO: 4148 - protein, 5 aa, Brucella spp.
TEDDI

SEQ ID NO: 4149 - protein, 15 aa, Brucella spp.
HLKPGPAGERLKDGA

SEQ ID NO: 4150 - protein, 5 aa, Brucella spp.
PTGAI

SEQ ID NO: 4151 - protein, 8 aa, Brucella spp.
ISGPEADK

SEQ ID NO: 4152 - protein, 6 aa, Brucella spp.
VPAGAY

SEQ ID NO: 4153 - protein, 9 aa, Brucella spp.
KDVAETPTL

SEQ ID NO: 4154 - protein, 7 aa, Brucella spp.
SAKQPDD

SEQ ID NO: 4155 - protein, 13 aa, Brucella spp.
DTRKALDAGHAKG

SEQ ID NO: 4156 - protein, 8 aa, Brucella spp.
DSATSSLG

SEQ ID NO: 4157 - protein, 7 aa, Brucella spp.
ARELEEK

SEQ ID NO: 4158 - protein, 11 aa, Brucella spp.
KGYDEPAKPSL

SEQ ID NO: 4159 - protein, 7 aa, Brucella spp.
GNPTSTD

SEQ ID NO: 4160 - protein, 6 aa, Brucella spp.
AGGPAK

SEQ ID NO: 4161 - protein, 6 aa, Brucella spp.
SSVANA

SEQ ID NO: 4162 - protein, 14 aa, Brucella spp.
ESASSTGGQITPPI

SEQ ID NO: 4163 - protein, 7 aa, Brucella spp.
RTGLRGM

SEQ ID NO: 4164 - protein, 6 aa, Brucella spp.
KEEMPD

SEQ ID NO: 4165 - protein, 4 aa, Brucella spp.
RDGA

SEQ ID NO: 4166 - protein, 14 aa, Brucella spp.
AGMAGADPFKTGNT

SEQ ID NO: 4167 - protein, 5 aa, Brucella spp.
EGEER

SEQ ID NO: 4168 - protein, 11 aa, Brucella spp.
ENDTDKELRRD

SEQ ID NO: 4169 - protein, 16 aa, Brucella spp.
TRPSARRAGDRAELER

SEQ ID NO: 4170 - protein, 30 aa, Brucella spp.
LDEGLEDTFPASDPVSVTSSAIPASADPKS

SEQ ID NO: 4171 - protein, 7 aa, Brucella spp.
ELKRPAD

SEQ ID NO: 4172 - protein, 9 aa, Brucella spp.
FSTAEESNA

SEQ ID NO: 4173 - protein, 7 aa, Brucella spp.
AAGQQGV

SEQ ID NO: 4174 - protein, 20 aa, Brucella spp.
HRGYDSDHPRVEGDVGKAGV

SEQ ID NO: 4175 - protein, 15 aa, Brucella spp.
EEQGVPRAQLSGTIQ

SEQ ID NO: 4176 - protein, 5 aa, Brucella spp.
YPPEP

SEQ ID NO: 4177 - protein, 7 aa, Brucella spp.
DPKKPGS

SEQ ID NO: 4178 - protein, 13 aa, Brucella spp.
TSGVSLQEQDPYN

SEQ ID NO: 4179 - protein, 12 aa, Brucella spp.
ALGGTQSLHTNS

SEQ ID NO: 4180 - protein, 5 aa, Brucella spp.
ETGVT

SEQ ID NO: 4181 - protein, 7 aa, Brucella spp.
AVESGLP

SEQ ID NO: 4182 - protein, 7 aa, Brucella spp.
AATRRQV

SEQ ID NO: 4183 - protein, 5 aa, Brucella spp.
VDKGE

SEQ ID NO: 4184 - protein, 4 aa, Brucella spp.
EQED

SEQ ID NO: 4185 - protein, 7 aa, Brucella spp.
SAVRQSQ

SEQ ID NO: 4186 - protein, 9 aa, Brucella spp.
MRNKQKVEA

SEQ ID NO: 4187 - protein, 8 aa, Brucella spp.
VARSGEGN

SEQ ID NO: 4188 - protein, 11 aa, Brucella spp.
EASRARATVGE

SEQ ID NO: 4189 - protein, 11 aa, Brucella spp.
GTAYKDEPEYQ

SEQ ID NO: 4190 - protein, 9 aa, Brucella spp.
AKQAGEKPR

SEQ ID NO: 4191 - protein, 9 aa, Brucella spp.
GQDGHDRGA

SEQ ID NO: 4192 - protein, 9 aa, Brucella spp.
QTPDEAADM

SEQ ID NO: 4193 - protein, 4 aa, Brucella spp.
AAGH

SEQ ID NO: 4194 - protein, 6 aa, Brucella spp.
RKKGAE

SEQ ID NO: 4195 - protein, 4 aa, Brucella spp.
GPGT

SEQ ID NO: 4196 - protein, 7 aa, Brucella spp.
AKKKGIA

SEQ ID NO: 4197 - protein, 6 aa, Brucella spp.
SDADRN

SEQ ID NO: 4198 - protein, 8 aa, Brucella spp.
GPAPSNQS

SEQ ID NO: 4199 - protein, 5 aa, Brucella spp.
NPRFA

SEQ ID NO: 4200 - protein, 19 aa, Brucella spp.
GDKITSKKLAAEAGVSTVP

SEQ ID NO: 4201 - protein, 8 aa, Brucella spp.
SAGGGGKG

SEQ ID NO: 4202 - protein, 8 aa, Brucella spp.
DEEAREGF

SEQ ID NO: 4203 - protein, 11 aa, Brucella spp.
SRNEAKSSFGD

SEQ ID NO: 4204 - protein, 5 aa, Brucella spp.
SIQRR

SEQ ID NO: 4205 - protein, 9 aa, Brucella spp.
IEEAPSPFL

SEQ ID NO: 4206 - protein, 8 aa, Brucella spp.
TRKAMGEQ

SEQ ID NO: 4207 - protein, 4 aa, Brucella spp.
EDPY

SEQ ID NO: 4208 - protein, 15 aa, Brucella spp.
YRPPVEGRNPDGTVI

SEQ ID NO: 4209 - protein, 4 aa, Brucella spp.
GVFE

SEQ ID NO: 4210 - protein, 5 aa, Brucella spp.
YPDGF

SEQ ID NO: 4211 - protein, 10 aa, Brucella spp.
KCSEDDARTL

SEQ ID NO: 4212 - protein, 16 aa, Brucella spp.
RRDTQISGRLSPQKHS

SEQ ID NO: 4213 - protein, 7 aa, Brucella spp.
EGEGGTT

SEQ ID NO: 4214 - protein, 5 aa, Brucella spp.
HPGSQ

SEQ ID NO: 4215 - protein, 4 aa, Brucella spp.
GGKP

SEQ ID NO: 4216 - protein, 6 aa, Brucella spp.
SRSGTG

SEQ ID NO: 4217 - protein, 6 aa, Brucella spp.
LPPDTS

SEQ ID NO: 4218 - protein, 12 aa, Brucella spp.
DGETVEAGQPLA

SEQ ID NO: 4219 - protein, 5 aa, Brucella spp.
ERRAT

SEQ ID NO: 4220 - protein, 18 aa, Brucella spp.
TAEAGSSLAVDELIMEFE

SEQ ID NO: 4221 - protein, 23 aa, Brucella spp.
LASHSDDLKARAEDAMDEASGRL

SEQ ID NO: 4222 - protein, 7 aa, Brucella spp.
QTVRERG

SEQ ID NO: 4223 - protein, 10 aa, Brucella spp.
VRENPGTATT

SEQ ID NO: 4224 - protein, 6 aa, Brucella spp.
DRCEDG

SEQ ID NO: 4225 - protein, 4 aa, Brucella spp.
GLSP

SEQ ID NO: 4226 - protein, 5 aa, Brucella spp.
KSITD

SEQ ID NO: 4227 - protein, 15 aa, Brucella spp.
GDPGQDEPAENRTEE

SEQ ID NO: 4228 - protein, 6 aa, Brucella spp.
TDSEGI

SEQ ID NO: 4229 - protein, 20 aa, Brucella spp.
ENESPRDEAAGKAGRAALPA

SEQ ID NO: 4230 - protein, 6 aa, Brucella spp.
DQDAGA

SEQ ID NO: 4231 - protein, 10 aa, Brucella spp.
YDEDSKPTAA

SEQ ID NO: 4232 - protein, 9 aa, Brucella spp.
SSNRDEVTG

SEQ ID NO: 4233 - protein, 38 aa, Brucella spp.
SKRPQGSEPRTPRGVESASEERTGIEQEEAPKKKQDAL

SEQ ID NO: 4234 - protein, 9 aa, Brucella spp.
EKAKAGRID

SEQ ID NO: 4235 - protein, 6 aa, Brucella spp.
DSEINR

SEQ ID NO: 4236 - protein, 7 aa, Brucella spp.
SKNNPLY

SEQ ID NO: 4237 - protein, 11 aa, Brucella spp.
DPGVGKTAIAE

SEQ ID NO: 4238 - protein, 6 aa, Brucella spp.
QVPDAL

SEQ ID NO: 4239 - protein, 6 aa, Brucella spp.
RYRGDF

SEQ ID NO: 4240 - protein, 11 aa, Brucella spp.
AGATSGGAMDA

SEQ ID NO: 4241 - protein, 6 aa, Brucella spp.
PALSSG

SEQ ID NO: 4242 - protein, 4 aa, Brucella spp.
TTYK

SEQ ID NO: 4243 - protein, 7 aa, Brucella spp.
NEPSIPD

SEQ ID NO: 4244 - protein, 6 aa, Brucella spp.
RKLPDK

SEQ ID NO: 4245 - protein, 6 aa, Brucella spp.
DETGAS

SEQ ID NO: 4246 - protein, 9 aa, Brucella spp.
ENKRKKTIG

SEQ ID NO: 4247 - protein, 13 aa, Brucella spp.
IPPKSVSKDDEEV

SEQ ID NO: 4248 - protein, 11 aa, Brucella spp.
AGLREPDKPIG

SEQ ID NO: 4249 - protein, 12 aa, Brucella spp.
GPTGVGKTEVAK

SEQ ID NO: 4250 - protein, 6 aa, Brucella spp.
GAPPGY

SEQ ID NO: 4251 - protein, 9 aa, Brucella spp.
LTDHNGKKI

SEQ ID NO: 4252 - protein, 8 aa, Brucella spp.
NAGASDMA

SEQ ID NO: 4253 - protein, 12 aa, Brucella spp.
FGSTRREGDDME

SEQ ID NO: 4254 - protein, 9 aa, Brucella spp.
KGYDERMGA

SEQ ID NO: 4255 - protein, 5 aa, Brucella spp.
HGGTV

SEQ ID NO: 4256 - protein, 9 aa, Brucella spp.
TTKEDGNTD

SEQ ID NO: 4257 - protein, 61 aa, Brucella spp.
EKPVKPKKDIPPEKKLPQRRKAAPKKAEKEKVLAGKDEPAPKPTTKATPIKSSVPKVPRKK

SEQ ID NO: 4258 - protein, 12 aa, Brucella spp.
IAGTSRQEQNYN

SEQ ID NO: 4259 - protein, 12 aa, Brucella spp.
SGCVSRKAGRLP

SEQ ID NO: 4260 - protein, 6 aa, Brucella spp.
DDQGNL

SEQ ID NO: 4261 - protein, 7 aa, Brucella spp.
KGHSQGE

SEQ ID NO: 4262 - protein, 8 aa, Brucella spp.
ERAGGRYY

SEQ ID NO: 4263 - protein, 8 aa, Brucella spp.
FTPATGPR

SEQ ID NO: 4264 - protein, 8 aa, Brucella spp.
ADQSGVSS

SEQ ID NO: 4265 - protein, 5 aa, Brucella spp.
DEIPA

SEQ ID NO: 4266 - protein, 15 aa, Brucella spp.
KRKALRKERREAHAE

SEQ ID NO: 4267 - protein, 7 aa, Brucella spp.
GSRKWGR

SEQ ID NO: 4268 - protein, 4 aa, Brucella spp.
GGRY

SEQ ID NO: 4269 - protein, 8 aa, Brucella spp.
AGAQGEHK

SEQ ID NO: 4270 - protein, 6 aa, Brucella spp.
DSERRE

SEQ ID NO: 4271 - protein, 4 aa, Brucella spp.
DQNK

SEQ ID NO: 4272 - protein, 6 aa, Brucella spp.
AAAKAG

SEQ ID NO: 4273 - protein, 4 aa, Brucella spp.
TDEA

SEQ ID NO: 4274 - protein, 4 aa, Brucella spp.
ADHV

SEQ ID NO: 4275 - protein, 7 aa, Brucella spp.
IEGRDDG

SEQ ID NO: 4276 - protein, 8 aa, Brucella spp.
ELSPYKGE

SEQ ID NO: 4277 - protein, 16 aa, Brucella spp.
DAPGIPGGLTAEGTRM

SEQ ID NO: 4278 - protein, 4 aa, Brucella spp.
EMQK

SEQ ID NO: 4279 - protein, 8 aa, Brucella spp.
GAASAASA

SEQ ID NO: 4280 - protein, 11 aa, Brucella spp.
RADEKSGISGL

SEQ ID NO: 4281 - protein, 6 aa, Brucella spp.
ACEGYT

SEQ ID NO: 4282 - protein, 22 aa, Brucella spp.
DEQPQRVTDQQTTTFEDADGKD

SEQ ID NO: 4283 - protein, 13 aa, Brucella spp.
EVRGDAKLEDGKT

SEQ ID NO: 4284 - protein, 9 aa, Brucella spp.
SKPKENTLD

SEQ ID NO: 4285 - protein, 6 aa, Brucella spp.
GTQFPT

SEQ ID NO: 4286 - protein, 8 aa, Brucella spp.
KAEAGQKF

SEQ ID NO: 4287 - protein, 8 aa, Brucella spp.
ASEDADRV

SEQ ID NO: 4288 - protein, 10 aa, Brucella spp.
QQAVPDDETK

SEQ ID NO: 4289 - protein, 8 aa, Brucella spp.
DKEQQDGM

SEQ ID NO: 4290 - protein, 6 aa, Brucella spp.
DTVARG

SEQ ID NO: 4291 - protein, 7 aa, Brucella spp.
TKRQASD

SEQ ID NO: 4292 - protein, 8 aa, Brucella spp.
DAGNRSAQ

SEQ ID NO: 4293 - protein, 8 aa, Brucella spp.
EAQGFTKK

SEQ ID NO: 4294 - protein, 9 aa, Brucella spp.
NLEREREKL

SEQ ID NO: 4295 - protein, 6 aa, Brucella spp.
NCDPDQ

SEQ ID NO: 4296 - protein, 11 aa, Brucella spp.
YPIPGNDDAAR

SEQ ID NO: 4297 - protein, 7 aa, Brucella spp.
IARQQGA

SEQ ID NO: 4298 - protein, 16 aa, Brucella spp.
VEAPVEPALQAPAEGA

SEQ ID NO: 4299 - protein, 8 aa, Brucella spp.
LAATEGKI

SEQ ID NO: 4300 - protein, 15 aa, Brucella spp.
IAKADKKAGRTAAEG

SEQ ID NO: 4301 - protein, 7 aa, Brucella spp.
AASGNKA

SEQ ID NO: 4302 - protein, 5 aa, Brucella spp.
SETDF

SEQ ID NO: 4303 - protein, 32 aa, Brucella spp.
ALSTDGSSEAVANANVDGKTVTEAAKDAVATI

SEQ ID NO: 4304 - protein, 4 aa, Brucella spp.
ADGL

SEQ ID NO: 4305 - protein, 11 aa, Brucella spp.
TAGDAEAAQAF

SEQ ID NO: 4306 - protein, 11 aa, Brucella spp.
ADVNPEAAERE

SEQ ID NO: 4307 - protein, 10 aa, Brucella spp.
ARQSGKPDNI

SEQ ID NO: 4308 - protein, 13 aa, Brucella spp.
KDAEKAIGAPAKI

SEQ ID NO: 4309 - protein, 19 aa, Brucella spp.
GIEKEESDFAAEVAAAAKG

SEQ ID NO: 4310 - protein, 6 aa, Brucella spp.
SGEALM

SEQ ID NO: 4311 - protein, 11 aa, Brucella spp.
ASKGGDRVTGD

SEQ ID NO: 4312 - protein, 10 aa, Brucella spp.
SQRQATAYMD

SEQ ID NO: 4313 - protein, 7 aa, Brucella spp.
GTGNPFF

SEQ ID NO: 4314 - protein, 4 aa, Brucella spp.
AAAL

SEQ ID NO: 4315 - protein, 4 aa, Brucella spp.
GTQV

SEQ ID NO: 4316 - protein, 14 aa, Brucella spp.
YSADPKKDPGATRF

SEQ ID NO: 4317 - protein, 4 aa, Brucella spp.
ENGG

SEQ ID NO: 4318 - protein, 4 aa, Brucella spp.
RMEG

SEQ ID NO: 4319 - protein, 10 aa, Brucella spp.
GLRTGRASAS

SEQ ID NO: 4320 - protein, 5 aa, Brucella spp.
IRDSG

SEQ ID NO: 4321 - protein, 7 aa, Brucella spp.
LNEQRRK

SEQ ID NO: 4322 - protein, 5 aa, Brucella spp.
AEQGR

SEQ ID NO: 4323 - protein, 4 aa, Brucella spp.
RDGM

SEQ ID NO: 4324 - protein, 14 aa, Brucella spp.
EKDSVISQDESRVL

SEQ ID NO: 4325 - protein, 8 aa, Brucella spp.
KLTDDTIA

SEQ ID NO: 4326 - protein, 7 aa, Brucella spp.
SATRQTA

SEQ ID NO: 4327 - protein, 6 aa, Brucella spp.
SGRGWP

SEQ ID NO: 4328 - protein, 4 aa, Brucella spp.
DEPF

SEQ ID NO: 4329 - protein, 30 aa, Brucella spp.
ALGGPKLAPRFSPNKTWSGAIGGAAAAVTG

SEQ ID NO: 4330 - protein, 5 aa, Brucella spp.
APGGW

SEQ ID NO: 4331 - protein, 11 aa, Brucella spp.
FGAKDSGRLLP

SEQ ID NO: 4332 - protein, 12 aa, Brucella spp.
EPDVPSAIFFSF

SEQ ID NO: 4333 - protein, 6 aa, Brucella spp.
SGTAGF

SEQ ID NO: 4334 - protein, 11 aa, Brucella spp.
RGNTRVDAQTI

SEQ ID NO: 4335 - protein, 12 aa, Brucella spp.
IRPGKAFTSADI

SEQ ID NO: 4336 - protein, 9 aa, Brucella spp.
KKIKDPDLA

SEQ ID NO: 4337 - protein, 4 aa, Brucella spp.
PRAP

SEQ ID NO: 4338 - protein, 7 aa, Brucella spp.
ADKEAIK

SEQ ID NO: 4339 - protein, 11 aa, Brucella spp.
IGRSDATVNAR

SEQ ID NO: 4340 - protein, 5 aa, Brucella spp.
DLGQG

SEQ ID NO: 4341 - protein, 7 aa, Brucella spp.
NEGSRTK

SEQ ID NO: 4342 - protein, 5 aa, Brucella spp.
AFSGR

SEQ ID NO: 4343 - protein, 8 aa, Brucella spp.
STKRSNPL

SEQ ID NO: 4344 - protein, 12 aa, Brucella spp.
YDEGRLQADEET

SEQ ID NO: 4345 - protein, 9 aa, Brucella spp.
VLDPSTNEY

SEQ ID NO: 4346 - protein, 7 aa, Brucella spp.
DEGPRYT

SEQ ID NO: 4347 - protein, 11 aa, Brucella spp.
ESTVDGVDTQA

SEQ ID NO: 4348 - protein, 14 aa, Brucella spp.
TRTGKPYSAKEIED

SEQ ID NO: 4349 - protein, 8 aa, Brucella spp.
ESVAGSGY

SEQ ID NO: 4350 - protein, 10 aa, Brucella spp.
VEPRGDRNFE

SEQ ID NO: 4351 - protein, 6 aa, Brucella spp.
DQGPRA

SEQ ID NO: 4352 - protein, 8 aa, Brucella spp.
RGNDKTRD

SEQ ID NO: 4353 - protein, 5 aa, Brucella spp.
NEGDA

SEQ ID NO: 4354 - protein, 10 aa, Brucella spp.
STAPGSEPDQ

SEQ ID NO: 4355 - protein, 8 aa, Brucella spp.
KSTGEFSI

SEQ ID NO: 4356 - protein, 14 aa, Brucella spp.
GGYTTGGESPGAQV

SEQ ID NO: 4357 - protein, 9 aa, Brucella spp.
AGAGQDDMR

SEQ ID NO: 4358 - protein, 10 aa, Brucella spp.
DYDVEQTGGT

SEQ ID NO: 4359 - protein, 5 aa, Brucella spp.
AENYY

SEQ ID NO: 4360 - protein, 6 aa, Brucella spp.
AENSPW

SEQ ID NO: 4361 - protein, 8 aa, Brucella spp.
IKNPHDGL

SEQ ID NO: 4362 - protein, 9 aa, Brucella spp.
LGGDAKYVK

SEQ ID NO: 4363 - protein, 12 aa, Brucella spp.
IGPYQDAKNGKR

SEQ ID NO: 4364 - protein, 4 aa, Brucella spp.
FSGT

SEQ ID NO: 4365 - protein, 19 aa, Brucella spp.
LYGNDTPDISGDDKKLRAS

SEQ ID NO: 4366 - protein, 7 aa, Brucella spp.
KADTDKV

SEQ ID NO: 4367 - protein, 15 aa, Brucella spp.
TGASLRDPKLAPRSV

SEQ ID NO: 4368 - protein, 6 aa, Brucella spp.
KDAGEG

SEQ ID NO: 4369 - protein, 5 aa, Brucella spp.
KNVSS

SEQ ID NO: 4370 - protein, 7 aa, Brucella spp.
ADSVPSG

SEQ ID NO: 4371 - protein, 5 aa, Brucella spp.
ETGIS

SEQ ID NO: 4372 - protein, 9 aa, Brucella spp.
IEDGATVEA

SEQ ID NO: 4373 - protein, 4 aa, Brucella spp.
GAAG

SEQ ID NO: 4374 - protein, 4 aa, Brucella spp.
DKVP

SEQ ID NO: 4375 - protein, 13 aa, Brucella spp.
GANTTVDRGSLDD

SEQ ID NO: 4376 - protein, 6 aa, Brucella spp.
IGEGTK

SEQ ID NO: 4377 - protein, 7 aa, Brucella spp.
IPDGERW

SEQ ID NO: 4378 - protein, 5 aa, Brucella spp.
IPARP

SEQ ID NO: 4379 - protein, 13 aa, Brucella spp.
SIGQSRKDASSDE

SEQ ID NO: 4380 - protein, 7 aa, Brucella spp.
DVSATGI

SEQ ID NO: 4381 - protein, 4 aa, Brucella spp.
QTAG

SEQ ID NO: 4382 - protein, 7 aa, Brucella spp.
RKTGRPG

SEQ ID NO: 4383 - protein, 5 aa, Brucella spp.
QRANI

SEQ ID NO: 4384 - protein, 8 aa, Brucella spp.
TTLGAGTK

SEQ ID NO: 4385 - protein, 14 aa, Brucella spp.
DPQNNKHKGGPTRL

SEQ ID NO: 4386 - protein, 13 aa, Brucella spp.
HKGSDNARGYTSI

SEQ ID NO: 4387 - protein, 6 aa, Brucella spp.
SGMERK

SEQ ID NO: 4388 - protein, 7 aa, Brucella spp.
KPIRQRA

SEQ ID NO: 4389 - protein, 8 aa, Brucella spp.
IPDSPTVS

SEQ ID NO: 4390 - protein, 5 aa, Brucella spp.
YCTPP

SEQ ID NO: 4391 - protein, 13 aa, Brucella spp.
AAHGGAGHDSDED

SEQ ID NO: 4392 - protein, 7 aa, Brucella spp.
GEESGDL

SEQ ID NO: 4393 - protein, 4 aa, Brucella spp.
AQTD

SEQ ID NO: 4394 - protein, 4 aa, Brucella spp.
LAER

SEQ ID NO: 4395 - protein, 8 aa, Brucella spp.
IRASAPSI

SEQ ID NO: 4396 - protein, 4 aa, Brucella spp.
RARA

SEQ ID NO: 4397 - protein, 6 aa, Brucella spp.
NGPQAT

SEQ ID NO: 4398 - protein, 5 aa, Brucella spp.
FNADK

SEQ ID NO: 4399 - protein, 6 aa, Brucella spp.
GSRRTE

SEQ ID NO: 4400 - protein, 5 aa, Brucella spp.
GDEEK

SEQ ID NO: 4401 - protein, 9 aa, Brucella spp.
AALAASGTV

SEQ ID NO: 4402 - protein, 11 aa, Brucella spp.
RPGSARQAQLD

SEQ ID NO: 4403 - protein, 10 aa, Brucella spp.
KTEKPSGEIG

SEQ ID NO: 4404 - protein, 4 aa, Brucella spp.
SFTL

SEQ ID NO: 4405 - protein, 7 aa, Brucella spp.
KGTVGPD

SEQ ID NO: 4406 - protein, 11 aa, Brucella spp.
PGFTSTASCES

SEQ ID NO: 4407 - protein, 8 aa, Brucella spp.
PTATQKAD

SEQ ID NO: 4408 - protein, 7 aa, Brucella spp.
TDITDPH

SEQ ID NO: 4409 - protein, 11 aa, Brucella spp.
HEQNASTSTVR

SEQ ID NO: 4410 - protein, 9 aa, Brucella spp.
LAGSSGANP

SEQ ID NO: 4411 - protein, 8 aa, Brucella spp.
AHGGANEA

SEQ ID NO: 4412 - protein, 8 aa, Brucella spp.
AKDKNDPF

SEQ ID NO: 4413 - protein, 6 aa, Brucella spp.
NYDPRA

SEQ ID NO: 4414 - protein, 12 aa, Brucella spp.
EDPQQKIGRPRQ

SEQ ID NO: 4415 - protein, 15 aa, Brucella spp.
TGATERDYVPLAKRK

SEQ ID NO: 4416 - protein, 4 aa, Brucella spp.
SPTG

SEQ ID NO: 4417 - protein, 13 aa, Brucella spp.
DTDRERSTEAATA

SEQ ID NO: 4418 - protein, 7 aa, Brucella spp.
RAPRHRE

SEQ ID NO: 4419 - protein, 6 aa, Brucella spp.
EELEEM

SEQ ID NO: 4420 - protein, 16 aa, Brucella spp.
REKARAEGRPPRYDGR

SEQ ID NO: 4421 - protein, 12 aa, Brucella spp.
RDRDPSEAPAGV

SEQ ID NO: 4422 - protein, 8 aa, Brucella spp.
APRDGETV

SEQ ID NO: 4423 - protein, 5 aa, Brucella spp.
FPNKD

SEQ ID NO: 4424 - protein, 6 aa, Brucella spp.
DGTPTY

SEQ ID NO: 4425 - protein, 5 aa, Brucella spp.
LTNAA

SEQ ID NO: 4426 - protein, 11 aa, Brucella spp.
DGAKLSKRHGA

SEQ ID NO: 4427 - protein, 5 aa, Brucella spp.
DDEIM

SEQ ID NO: 4428 - protein, 6 aa, Brucella spp.
INKGAA

SEQ ID NO: 4429 - protein, 6 aa, Brucella spp.
SSDDQA

SEQ ID NO: 4430 - protein, 17 aa, Brucella spp.
IEGGKELAEALDDKGRA

SEQ ID NO: 4431 - protein, 5 aa, Brucella spp.
KERAK

SEQ ID NO: 4432 - protein, 9 aa, Brucella spp.
ASLLNDEGR

SEQ ID NO: 4433 - protein, 6 aa, Brucella spp.
AEAEGL

SEQ ID NO: 4434 - protein, 8 aa, Brucella spp.
TGRATSPG

SEQ ID NO: 4435 - protein, 5 aa, Brucella spp.
AAQRR

SEQ ID NO: 4436 - protein, 6 aa, Brucella spp.
QARRVP

SEQ ID NO: 4437 - protein, 9 aa, Brucella spp.
ETGIPPSFD

SEQ ID NO: 4438 - protein, 5 aa, Brucella spp.
ASKSG

SEQ ID NO: 4439 - protein, 13 aa, Brucella spp.
IAPGLSPQKKFAP

SEQ ID NO: 4440 - protein, 19 aa, Brucella spp.
VQPVRPAPAPQNSEAPATV

SEQ ID NO: 4441 - protein, 8 aa, Brucella spp.
GDTANPGE

SEQ ID NO: 4442 - protein, 5 aa, Brucella spp.
EEEAT

SEQ ID NO: 4443 - protein, 4 aa, Brucella spp.
RREG

SEQ ID NO: 4444 - protein, 6 aa, Brucella spp.
ANPAYE

SEQ ID NO: 4445 - protein, 9 aa, Brucella spp.
AAPHGTEDV

SEQ ID NO: 4446 - protein, 14 aa, Brucella spp.
SLTDAGGRVTASDI

SEQ ID NO: 4447 - protein, 15 aa, Brucella spp.
ESAAGKRFEGTLRKG

SEQ ID NO: 4448 - protein, 6 aa, Brucella spp.
PMPENA

SEQ ID NO: 4449 - protein, 7 aa, Brucella spp.
HTEREGK

SEQ ID NO: 4450 - protein, 5 aa, Brucella spp.
GRHIR

SEQ ID NO: 4451 - protein, 6 aa, Brucella spp.
ELDAPA

SEQ ID NO: 4452 - protein, 6 aa, Brucella spp.
AASGHA

SEQ ID NO: 4453 - protein, 13 aa, Brucella spp.
ELVPPGAIPGPDQ

SEQ ID NO: 4454 - protein, 9 aa, Brucella spp.
RRAGGTPED

SEQ ID NO: 4455 - protein, 6 aa, Brucella spp.
DPARIE

SEQ ID NO: 4456 - protein, 4 aa, Brucella spp.
DALE

SEQ ID NO: 4457 - protein, 7 aa, Brucella spp.
GASVGDR

SEQ ID NO: 4458 - protein, 6 aa, Brucella spp.
AVNGKT

SEQ ID NO: 4459 - protein, 6 aa, Brucella spp.
PGNPVS

SEQ ID NO: 4460 - protein, 4 aa, Brucella spp.
NDHR

SEQ ID NO: 4461 - protein, 7 aa, Brucella spp.
ESEPDGT

SEQ ID NO: 4462 - protein, 17 aa, Brucella spp.
ENAPEALPGDPCRILML

SEQ ID NO: 4463 - protein, 12 aa, Brucella spp.
GSKDETERQAVA

SEQ ID NO: 4464 - protein, 9 aa, Brucella spp.
NAAKGDVIG

SEQ ID NO: 4465 - protein, 4 aa, Brucella spp.
RTSD

SEQ ID NO: 4466 - protein, 9 aa, Brucella spp.
IEPDENLPG

SEQ ID NO: 4467 - protein, 6 aa, Brucella spp.
KGRTGV

SEQ ID NO: 4468 - protein, 19 aa, Brucella spp.
EKSGGKSGDWAVSDPASMR

SEQ ID NO: 4469 - protein, 7 aa, Brucella spp.
KREEIAA

SEQ ID NO: 4470 - protein, 12 aa, Brucella spp.
KARTRDQSAPRG

SEQ ID NO: 4471 - protein, 6 aa, Brucella spp.
AKRAAG

SEQ ID NO: 4472 - protein, 9 aa, Brucella spp.
KKASPSKGL

SEQ ID NO: 4473 - protein, 6 aa, Brucella spp.
FDPPAL

SEQ ID NO: 4474 - protein, 7 aa, Brucella spp.
AYEEGGA

SEQ ID NO: 4475 - protein, 9 aa, Brucella spp.
DTPSFQGAP

SEQ ID NO: 4476 - protein, 9 aa, Brucella spp.
DDLAKELED

SEQ ID NO: 4477 - protein, 5 aa, Brucella spp.
KMAPS

SEQ ID NO: 4478 - protein, 13 aa, Brucella spp.
KAASGEPLPLGDA

SEQ ID NO: 4479 - protein, 7 aa, Brucella spp.
QATPSQI

SEQ ID NO: 4480 - protein, 6 aa, Brucella spp.
ETVPEI

SEQ ID NO: 4481 - protein, 12 aa, Brucella spp.
GTGGDQSGSYNV

SEQ ID NO: 4482 - protein, 18 aa, Brucella spp.
VAKHGNRALSSRSGAADA

SEQ ID NO: 4483 - protein, 11 aa, Brucella spp.
DADTIGRSISE

SEQ ID NO: 4484 - protein, 6 aa, Brucella spp.
GPSRVE

SEQ ID NO: 4485 - protein, 8 aa, Brucella spp.
LSNPASVK

SEQ ID NO: 4486 - protein, 11 aa, Brucella spp.
DEMTTAGTTQV

SEQ ID NO: 4487 - protein, 15 aa, Brucella spp.
SPAELKGGEAAENAK

SEQ ID NO: 4488 - protein, 6 aa, Brucella spp.
GKDSAY

SEQ ID NO: 4489 - protein, 9 aa, Brucella spp.
KAENLKDGI

SEQ ID NO: 4490 - protein, 7 aa, Brucella spp.
QSIDSGA

SEQ ID NO: 4491 - protein, 14 aa, Brucella spp.
RSEGGGLGIGGGSG

SEQ ID NO: 4492 - protein, 9 aa, Brucella spp.
GAANALTRT

SEQ ID NO: 4493 - protein, 6 aa, Brucella spp.
GERPTD

SEQ ID NO: 4494 - protein, 20 aa, Brucella spp.
PATTGSQSAPAGGSTNGGGI

SEQ ID NO: 4495 - protein, 42 aa, Brucella spp.
LGGEPSGSGNGAAPAAPAAPAQPDAGQPQAPAAPANPVPSSQ

SEQ ID NO: 4496 - protein, 6 aa, Brucella spp.
SLGKGI

SEQ ID NO: 4497 - protein, 8 aa, Brucella spp.
DPGTMSPY

SEQ ID NO: 4498 - protein, 8 aa, Brucella spp.
DDGAETDL

SEQ ID NO: 4499 - protein, 14 aa, Brucella spp.
TGRPANQQDNITTG

SEQ ID NO: 4500 - protein, 8 aa, Brucella spp.
KERRGDYL

SEQ ID NO: 4501 - protein, 7 aa, Brucella spp.
NELPRGT

SEQ ID NO: 4502 - protein, 12 aa, Brucella spp.
GELKTKPTQHSV

SEQ ID NO: 4503 - protein, 9 aa, Brucella spp.
REIPESERR

SEQ ID NO: 4504 - protein, 5 aa, Brucella spp.
EGLDS

SEQ ID NO: 4505 - protein, 9 aa, Brucella spp.
DPAPKPRMD

SEQ ID NO: 4506 - protein, 6 aa, Brucella spp.
HNPEGE

SEQ ID NO: 4507 - protein, 5 aa, Brucella spp.
TGLKD

SEQ ID NO: 4508 - protein, 9 aa, Brucella spp.
ESEDPAPYL

SEQ ID NO: 4509 - protein, 9 aa, Brucella spp.
FGERGAEGK

SEQ ID NO: 4510 - protein, 14 aa, Brucella spp.
EDASSSEFDPTREP

SEQ ID NO: 4511 - protein, 10 aa, Brucella spp.
RAAAGDLGGT

SEQ ID NO: 4512 - protein, 6 aa, Brucella spp.
KPDSKI

SEQ ID NO: 4513 - protein, 7 aa, Brucella spp.
MSPDGVL

SEQ ID NO: 4514 - protein, 6 aa, Brucella spp.
SRPFEP

SEQ ID NO: 4515 - protein, 4 aa, Brucella spp.
SNSA

SEQ ID NO: 4516 - protein, 17 aa, Brucella spp.
SFDKANRTSLKAARGIG

SEQ ID NO: 4517 - protein, 11 aa, Brucella spp.
ITESGNPNVLA

SEQ ID NO: 4518 - protein, 17 aa, Brucella spp.
SVQQPGGQGGSTGGQRE

SEQ ID NO: 4519 - protein, 14 aa, Brucella spp.
HEDPDNAPSDGPNM

SEQ ID NO: 4520 - protein, 8 aa, Brucella spp.
DSRGNPTV

SEQ ID NO: 4521 - protein, 18 aa, Brucella spp.
GSFGRAAVPSGASTGAHE

SEQ ID NO: 4522 - protein, 12 aa, Brucella spp.
LRDGGSRYLGKG

SEQ ID NO: 4523 - protein, 11 aa, Brucella spp.
DGSANKGNLGA

SEQ ID NO: 4524 - protein, 9 aa, Brucella spp.
KAAAQASGL

SEQ ID NO: 4525 - protein, 8 aa, Brucella spp.
GAHADNPI

SEQ ID NO: 4526 - protein, 24 aa, Brucella spp.
LKDAGHNTNVGDEGGFAPNLKNAQ

SEQ ID NO: 4527 - protein, 8 aa, Brucella spp.
AGFKPGED

SEQ ID NO: 4528 - protein, 16 aa, Brucella spp.
VYEGERKTRDPKAQAK

SEQ ID NO: 4529 - protein, 5 aa, Brucella spp.
MAEDD

SEQ ID NO: 4530 - protein, 6 aa, Brucella spp.
GSLSET

SEQ ID NO: 4531 - protein, 7 aa, Brucella spp.
TAHKAGY

SEQ ID NO: 4532 - protein, 10 aa, Brucella spp.
RSGETEDSTI

SEQ ID NO: 4533 - protein, 17 aa, Brucella spp.
GQIKTGSLARSDRTAKY

SEQ ID NO: 4534 - protein, 15 aa, Brucella spp.
DKQARYAGRSALKLL

SEQ ID NO: 4535 - protein, 26 aa, Brucella spp.
KTQASSVNAPKAPSPANFDKKQELEA

SEQ ID NO: 4536 - protein, 4 aa, Brucella spp.
KAGQ

SEQ ID NO: 4537 - protein, 14 aa, Brucella spp.
TGRRGGLSKGKGGS

SEQ ID NO: 4538 - protein, 4 aa, Brucella spp.
NFYG

SEQ ID NO: 4539 - protein, 5 aa, Brucella spp.
RENKS

SEQ ID NO: 4540 - protein, 9 aa, Brucella spp.
DGAANQGQV

SEQ ID NO: 4541 - protein, 13 aa, Brucella spp.
VSRSSAETDFSKR

SEQ ID NO: 4542 - protein, 4 aa, Brucella spp.
AADL

SEQ ID NO: 4543 - protein, 7 aa, Brucella spp.
WARSGRG

SEQ ID NO: 4544 - protein, 26 aa, Brucella spp.
HSMSDPAKYRSKEEVQKMRSEHDPIE

SEQ ID NO: 4545 - protein, 6 aa, Brucella spp.
ATEEEL

SEQ ID NO: 4546 - protein, 18 aa, Brucella spp.
AEHDPEPDASELYTDILL

SEQ ID NO: 4547 - protein, 6 aa, Brucella spp.
PTMEEG

SEQ ID NO: 4548 - protein, 11 aa, Brucella spp.
KKEGDKVTSGD

SEQ ID NO: 4549 - protein, 6 aa, Brucella spp.
TDKATM

SEQ ID NO: 4550 - protein, 5 aa, Brucella spp.
DEGTI

SEQ ID NO: 4551 - protein, 8 aa, Brucella spp.
EGTEGVKV

SEQ ID NO: 4552 - protein, 54 aa, Brucella spp.
DGESAADIGSAPAAKAEAAKEEPKAEENKADAVPAAPKAPAVEVASDPDIPAGT

SEQ ID NO: 4553 - protein, 4 aa, Brucella spp.
EMRR

SEQ ID NO: 4554 - protein, 9 aa, Brucella spp.
GPSGAAARV

SEQ ID NO: 4555 - protein, 5 aa, Brucella spp.
ADAKG

SEQ ID NO: 4556 - protein, 5 aa, Brucella spp.
IRDPN

SEQ ID NO: 4557 - protein, 9 aa, Brucella spp.
IHKQGKDAT

SEQ ID NO: 4558 - protein, 8 aa, Brucella spp.
AEELAGQG

SEQ ID NO: 4559 - protein, 7 aa, Brucella spp.
VKKTGRL

SEQ ID NO: 4560 - protein, 11 aa, Brucella spp.
GFPQSSVGTEI

SEQ ID NO: 4561 - protein, 7 aa, Brucella spp.
PTMEEGN

SEQ ID NO: 4562 - protein, 8 aa, Brucella spp.
GDKVAPGD

SEQ ID NO: 4563 - protein, 7 aa, Brucella spp.
ETDKATM

SEQ ID NO: 4564 - protein, 5 aa, Brucella spp.
VDEGT

SEQ ID NO: 4565 - protein, 6 aa, Brucella spp.
AGTEGV

SEQ ID NO: 4566 - protein, 60 aa, Brucella spp.
EEGEDVAAAAKGAGAAPKAEAPKDEPKPAEAKKEAAAPAAAPAPARSEQPAVAPAVNKGE

SEQ ID NO: 4567 - protein, 5 aa, Brucella spp.
DAGVD

SEQ ID NO: 4568 - protein, 9 aa, Brucella spp.
VKGSGPHGR

SEQ ID NO: 4569 - protein, 25 aa, Brucella spp.
ALASGGAKAVSAQAESAAAPKPMSD

SEQ ID NO: 4570 - protein, 4 aa, Brucella spp.
SKQT

SEQ ID NO: 4571 - protein, 9 aa, Brucella spp.
KTEKGEVPA

SEQ ID NO: 4572 - protein, 4 aa, Brucella spp.
ESKT

SEQ ID NO: 4573 - protein, 22 aa, Brucella spp.
ARRARDRKLKPEEYQGGSTSVS

SEQ ID NO: 4574 - protein, 6 aa, Brucella spp.
GEERAV

SEQ ID NO: 4575 - protein, 6 aa, Brucella spp.
TDHRAV

SEQ ID NO: 4576 - protein, 7 aa, Brucella spp.
SGPGGYV

SEQ ID NO: 4577 - protein, 6 aa, Brucella spp.
GTITPD

SEQ ID NO: 4578 - protein, 10 aa, Brucella spp.
QRSRGVSARL

SEQ ID NO: 4579 - protein, 38 aa, Brucella spp.
KAASGSNPAEISVGKTSKQPMQPQNPVPKGVLGEGSYK

SEQ ID NO: 4580 - protein, 13 aa, Brucella spp.
GARPRALPGIEPD

SEQ ID NO: 4581 - protein, 8 aa, Brucella spp.
DAETSAIA

SEQ ID NO: 4582 - protein, 6 aa, Brucella spp.
KQLEKR

SEQ ID NO: 4583 - protein, 13 aa, Brucella spp.
AKVEKGANSVTAH

SEQ ID NO: 4584 - protein, 11 aa, Brucella spp.
VETKDGKTQTL

SEQ ID NO: 4585 - protein, 4 aa, Brucella spp.
VKTD

SEQ ID NO: 4586 - protein, 5 aa, Brucella spp.
GKTNV

SEQ ID NO: 4587 - protein, 5 aa, Brucella spp.
AGPPM

SEQ ID NO: 4588 - protein, 12 aa, Brucella spp.
LTEAKAKEQGYD

SEQ ID NO: 4589 - protein, 6 aa, Brucella spp.
FSANGK

SEQ ID NO: 4590 - protein, 5 aa, Brucella spp.
LGEDQ

SEQ ID NO: 4591 - protein, 4 aa, Brucella spp.
KTGQ

SEQ ID NO: 4592 - protein, 4 aa, Brucella spp.
TTEE

SEQ ID NO: 4593 - protein, 7 aa, Brucella spp.
TLSETMK

SEQ ID NO: 4594 - protein, 5 aa, Brucella spp.
GGNTI

SEQ ID NO: 4595 - protein, 16 aa, Brucella spp.
GRLRHPEKAHRPDNEV

SEQ ID NO: 4596 - protein, 10 aa, Brucella spp.
VSRGYGETRE

SEQ ID NO: 4597 - protein, 14 aa, Brucella spp.
GIPNALDPNEPENI

SEQ ID NO: 4598 - protein, 9 aa, Brucella spp.
RDDLADGGA

SEQ ID NO: 4599 - protein, 7 aa, Brucella spp.
EAAPATT

SEQ ID NO: 4600 - protein, 4 aa, Brucella spp.
TVPS

SEQ ID NO: 4601 - protein, 4 aa, Brucella spp.
EERN

SEQ ID NO: 4602 - protein, 4 aa, Brucella spp.
PTRK

SEQ ID NO: 4603 - protein, 4 aa, Brucella spp.
TIGK

SEQ ID NO: 4604 - protein, 13 aa, Brucella spp.
SPLTRSSHHAGED

SEQ ID NO: 4605 - protein, 13 aa, Brucella spp.
SERKEKQPERTIN

SEQ ID NO: 4606 - protein, 15 aa, Brucella spp.
GRGERAGQSAEGPKQ

SEQ ID NO: 4607 - protein, 4 aa, Brucella spp.
PEKH

SEQ ID NO: 4608 - protein, 10 aa, Brucella spp.
GGPTRQESTR

SEQ ID NO: 4609 - protein, 5 aa, Brucella spp.
DEAPQ

SEQ ID NO: 4610 - protein, 5 aa, Brucella spp.
TPDNG

SEQ ID NO: 4611 - protein, 10 aa, Brucella spp.
TLKRAAADGM

SEQ ID NO: 4612 - protein, 6 aa, Brucella spp.
QTPQAF

SEQ ID NO: 4613 - protein, 5 aa, Brucella spp.
DFTDD

SEQ ID NO: 4614 - protein, 8 aa, Brucella spp.
GSADNTKL

SEQ ID NO: 4615 - protein, 6 aa, Brucella spp.
RTGNGY

SEQ ID NO: 4616 - protein, 7 aa, Brucella spp.
LNGHSDA

SEQ ID NO: 4617 - protein, 7 aa, Brucella spp.
TRGAGDI

SEQ ID NO: 4618 - protein, 13 aa, Brucella spp.
THFPPSDPQWKGA

SEQ ID NO: 4619 - protein, 7 aa, Brucella spp.
REAGGRI

SEQ ID NO: 4620 - protein, 8 aa, Brucella spp.
APKIGPHR

SEQ ID NO: 4621 - protein, 8 aa, Brucella spp.
IKATTNEK

SEQ ID NO: 4622 - protein, 8 aa, Brucella spp.
RAAEAGAG

SEQ ID NO: 4623 - protein, 5 aa, Brucella spp.
GEGLG

SEQ ID NO: 4624 - protein, 9 aa, Brucella spp.
KIAEGEGTD

SEQ ID NO: 4625 - protein, 10 aa, Brucella spp.
KKVTGGYSGS

SEQ ID NO: 4626 - protein, 15 aa, Brucella spp.
NSINAPELARRAEDA

SEQ ID NO: 4627 - protein, 11 aa, Brucella spp.
GDVSSRADAEE

SEQ ID NO: 4628 - protein, 4 aa, Brucella spp.
RSGA

SEQ ID NO: 4629 - protein, 5 aa, Brucella spp.
SYGQP

SEQ ID NO: 4630 - protein, 10 aa, Brucella spp.
GSDFAPRDAN

SEQ ID NO: 4631 - protein, 8 aa, Brucella spp.
RAFTPADK

SEQ ID NO: 4632 - protein, 4 aa, Brucella spp.
SRAG

SEQ ID NO: 4633 - protein, 4 aa, Brucella spp.
TSNA

SEQ ID NO: 4634 - protein, 7 aa, Brucella spp.
ASEAGAY

SEQ ID NO: 4635 - protein, 20 aa, Brucella spp.
LSEPRQKPAVALPDEQGENM

SEQ ID NO: 4636 - protein, 4 aa, Brucella spp.
SPAM

SEQ ID NO: 4637 - protein, 8 aa, Brucella spp.
GESGTGKE

SEQ ID NO: 4638 - protein, 8 aa, Brucella spp.
YGRRRKGP

SEQ ID NO: 4639 - protein, 20 aa, Brucella spp.
GAFTGAQNRSSGRFEQANGG

SEQ ID NO: 4640 - protein, 7 aa, Brucella spp.
GRTPIKT

SEQ ID NO: 4641 - protein, 9 aa, Brucella spp.
LRERSEDVP

SEQ ID NO: 4642 - protein, 12 aa, Brucella spp.
AEEGVPEKRITN

SEQ ID NO: 4643 - protein, 7 aa, Brucella spp.
ELAKPDV

SEQ ID NO: 4644 - protein, 7 aa, Brucella spp.
AAGGEME

SEQ ID NO: 4645 - protein, 8 aa, Brucella spp.
SDLPPPGL

SEQ ID NO: 4646 - protein, 7 aa, Brucella spp.
TRGNQIK

SEQ ID NO: 4647 - protein, 6 aa, Brucella spp.
GQGEGR

SEQ ID NO: 4648 - protein, 6 aa, Brucella spp.
ITPDRT

SEQ ID NO: 4649 - protein, 4 aa, Brucella spp.
GKAA

SEQ ID NO: 4650 - protein, 4 aa, Brucella spp.
QSTS

SEQ ID NO: 4651 - protein, 6 aa, Brucella spp.
SDTGME

SEQ ID NO: 4652 - protein, 18 aa, Brucella spp.
HLPPPTKDSLEKAPDGKP

SEQ ID NO: 4653 - protein, 6 aa, Brucella spp.
PPGNTN

SEQ ID NO: 4654 - protein, 5 aa, Brucella spp.
RRYQE

SEQ ID NO: 4655 - protein, 5 aa, Brucella spp.
NRIPT

SEQ ID NO: 4656 - protein, 7 aa, Brucella spp.
DDVAAGN

SEQ ID NO: 4657 - protein, 11 aa, Brucella spp.
VRSSDGDVGAL

SEQ ID NO: 4658 - protein, 7 aa, Brucella spp.
KSQRNEL

SEQ ID NO: 4659 - protein, 9 aa, Brucella spp.
KDQIDERRR

SEQ ID NO: 4660 - protein, 5 aa, Brucella spp.
ENDGS

SEQ ID NO: 4661 - protein, 9 aa, Brucella spp.
SEDAVGKSL

SEQ ID NO: 4662 - protein, 7 aa, Brucella spp.
TSIAPEV

SEQ ID NO: 4663 - protein, 8 aa, Brucella spp.
RATGRTVH

SEQ ID NO: 4664 - protein, 10 aa, Brucella spp.
MARGGGSRSF

SEQ ID NO: 4665 - protein, 9 aa, Brucella spp.
EDAESEDHS

SEQ ID NO: 4666 - protein, 7 aa, Brucella spp.
AQRSSAW

SEQ ID NO: 4667 - protein, 6 aa, Brucella spp.
ASEAID

SEQ ID NO: 4668 - protein, 8 aa, Brucella spp.
AKEERGEG

SEQ ID NO: 4669 - protein, 11 aa, Brucella spp.
NGKGLPGDDRQ

SEQ ID NO: 4670 - protein, 8 aa, Brucella spp.
TREKGTGL

SEQ ID NO: 4671 - protein, 5 aa, Brucella spp.
DHGGN

SEQ ID NO: 4672 - protein, 22 aa, Brucella spp.
DPPIPSDADSGNDEKHTAGQVI

SEQ ID NO: 4673 - protein, 13 aa, Brucella spp.
DEGHETRTAFDAD

SEQ ID NO: 4674 - protein, 4 aa, Brucella spp.
NDRA

SEQ ID NO: 4675 - protein, 5 aa, Brucella spp.
KQHPE

SEQ ID NO: 4676 - protein, 5 aa, Brucella spp.
GNIET

SEQ ID NO: 4677 - protein, 12 aa, Brucella spp.
LETSKLKREVSD

SEQ ID NO: 4678 - protein, 8 aa, Brucella spp.
LRKRTGDQ

SEQ ID NO: 4679 - protein, 5 aa, Brucella spp.
VAPTN

SEQ ID NO: 4680 - protein, 8 aa, Brucella spp.
GPSGAGKE

SEQ ID NO: 4681 - protein, 10 aa, Brucella spp.
AQSSRANGPF

SEQ ID NO: 4682 - protein, 5 aa, Brucella spp.
TITPE

SEQ ID NO: 4683 - protein, 14 aa, Brucella spp.
MDGGERKVGALEEA

SEQ ID NO: 4684 - protein, 8 aa, Brucella spp.
DMPRETQN

SEQ ID NO: 4685 - protein, 8 aa, Brucella spp.
RVGGTKRV

SEQ ID NO: 4686 - protein, 6 aa, Brucella spp.
STAQNL

SEQ ID NO: 4687 - protein, 5 aa, Brucella spp.
RREDI

SEQ ID NO: 4688 - protein, 13 aa, Brucella spp.
EQAGIKPRKIGPD

SEQ ID NO: 4689 - protein, 7 aa, Brucella spp.
GDDPDEL

SEQ ID NO: 4690 - protein, 12 aa, Brucella spp.
DTLPRAPTESDQ

SEQ ID NO: 4691 - protein, 5 aa, Brucella spp.
ARERF

SEQ ID NO: 4692 - protein, 6 aa, Brucella spp.
GNISRT

SEQ ID NO: 4693 - protein, 6 aa, Brucella spp.
AAEEND

SEQ ID NO: 4694 - protein, 5 aa, Brucella spp.
DTSAR

SEQ ID NO: 4695 - protein, 6 aa, Brucella spp.
GSQPDV

SEQ ID NO: 4696 - protein, 7 aa, Brucella spp.
AAGADEA

SEQ ID NO: 4697 - protein, 8 aa, Brucella spp.
SSDELNAG

SEQ ID NO: 4698 - protein, 6 aa, Brucella spp.
GKPEAN

SEQ ID NO: 4699 - protein, 5 aa, Brucella spp.
ADVQD

SEQ ID NO: 4700 - protein, 5 aa, Brucella spp.
LETSS

SEQ ID NO: 4701 - protein, 4 aa, Brucella spp.
IRPN

SEQ ID NO: 4702 - protein, 5 aa, Brucella spp.
RIKPR

SEQ ID NO: 4703 - protein, 5 aa, Brucella spp.
NVPPG

SEQ ID NO: 4704 - protein, 5 aa, Brucella spp.
DPAYP

SEQ ID NO: 4705 - protein, 18 aa, Brucella spp.
HPDPDKPYLARENRSRVG

SEQ ID NO: 4706 - protein, 8 aa, Brucella spp.
ATDPPPTW

SEQ ID NO: 4707 - protein, 5 aa, Brucella spp.
VTPAS

SEQ ID NO: 4708 - protein, 5 aa, Brucella spp.
AAPQE

SEQ ID NO: 4709 - protein, 5 aa, Brucella spp.
ATRIY

SEQ ID NO: 4710 - protein, 12 aa, Brucella spp.
ESKENKELALAD

SEQ ID NO: 4711 - protein, 7 aa, Brucella spp.
LDGSKGF

SEQ ID NO: 4712 - protein, 10 aa, Brucella spp.
ALSEPKPTRA

SEQ ID NO: 4713 - protein, 25 aa, Brucella spp.
RYNSGSAGEDGARSQFQRSNEARLE

SEQ ID NO: 4714 - protein, 7 aa, Brucella spp.
NPRPATL

SEQ ID NO: 4715 - protein, 8 aa, Brucella spp.
AGKAQSIA

SEQ ID NO: 4716 - protein, 5 aa, Brucella spp.
PVQQR

SEQ ID NO: 4717 - protein, 5 aa, Brucella spp.
NLEKE

SEQ ID NO: 4718 - protein, 9 aa, Brucella spp.
RARTKEGAL

SEQ ID NO: 4719 - protein, 19 aa, Brucella spp.
RQRGGGGFLGGPGETQIEA

SEQ ID NO: 4720 - protein, 8 aa, Brucella spp.
RQTRRKVP

SEQ ID NO: 4721 - protein, 4 aa, Brucella spp.
TNAG

SEQ ID NO: 4722 - protein, 12 aa, Brucella spp.
SDPDNAAQAEDV

SEQ ID NO: 4723 - protein, 6 aa, Brucella spp.
IEPQDH

SEQ ID NO: 4724 - protein, 9 aa, Brucella spp.
NLDESAREA

SEQ ID NO: 4725 - protein, 11 aa, Brucella spp.
AAGSEEGRPIP

SEQ ID NO: 4726 - protein, 5 aa, Brucella spp.
TGEGV

SEQ ID NO: 4727 - protein, 13 aa, Brucella spp.
SDVQRENLEDGSV

SEQ ID NO: 4728 - protein, 13 aa, Brucella spp.
RGIRPEKPEIDWE

SEQ ID NO: 4729 - protein, 8 aa, Brucella spp.
QTNRGERA

SEQ ID NO: 4730 - protein, 6 aa, Brucella spp.
ENPKKE

SEQ ID NO: 4731 - protein, 5 aa, Brucella spp.
PGGVV

SEQ ID NO: 4732 - protein, 5 aa, Brucella spp.
GATGH

SEQ ID NO: 4733 - protein, 15 aa, Brucella spp.
PSGGFQGQASDIERH

SEQ ID NO: 4734 - protein, 7 aa, Brucella spp.
TGRDYDT

SEQ ID NO: 4735 - protein, 4 aa, Brucella spp.
SQHE

SEQ ID NO: 4736 - protein, 17 aa, Brucella spp.
ENKSSMVKSREGVPTPQ

SEQ ID NO: 4737 - protein, 6 aa, Brucella spp.
QKDAKR

SEQ ID NO: 4738 - protein, 11 aa, Brucella spp.
AHQSKNSDIEL

SEQ ID NO: 4739 - protein, 5 aa, Brucella spp.
TGCGK

SEQ ID NO: 4740 - protein, 6 aa, Brucella spp.
TTLTEA

SEQ ID NO: 4741 - protein, 5 aa, Brucella spp.
GYVGE

SEQ ID NO: 4742 - protein, 6 aa, Brucella spp.
NVERAQ

SEQ ID NO: 4743 - protein, 21 aa, Brucella spp.
KISRKSDNPSITRDVSGEGVQ

SEQ ID NO: 4744 - protein, 13 aa, Brucella spp.
SVPPQGGRKHPQQ

SEQ ID NO: 4745 - protein, 9 aa, Brucella spp.
ARGEKTSIG

SEQ ID NO: 4746 - protein, 6 aa, Brucella spp.
SVDERR

SEQ ID NO: 4747 - protein, 4 aa, Brucella spp.
EPKN

SEQ ID NO: 4748 - protein, 11 aa, Brucella spp.
AVERKTGARGL

SEQ ID NO: 4749 - protein, 6 aa, Brucella spp.
VDGSAR

SEQ ID NO: 4750 - protein, 9 aa, Brucella spp.
GSETGGADG

SEQ ID NO: 4751 - protein, 13 aa, Brucella spp.
QKNAADDDPAPDA

SEQ ID NO: 4752 - protein, 4 aa, Brucella spp.
PDGT

SEQ ID NO: 4753 - protein, 6 aa, Brucella spp.
GTARAK

SEQ ID NO: 4754 - protein, 11 aa, Brucella spp.
SKFTDREDYHE

SEQ ID NO: 4755 - protein, 8 aa, Brucella spp.
LQEPEEDA

SEQ ID NO: 4756 - protein, 7 aa, Brucella spp.
KISPEVV

SEQ ID NO: 4757 - protein, 8 aa, Brucella spp.
TASQIDDY

SEQ ID NO: 4758 - protein, 5 aa, Brucella spp.
LADTV

SEQ ID NO: 4759 - protein, 9 aa, Brucella spp.
RQMEKTQRE

SEQ ID NO: 4760 - protein, 14 aa, Brucella spp.
KELGDSEDGRDEVA

SEQ ID NO: 4761 - protein, 14 aa, Brucella spp.
TKTKLSKEAREKAL

SEQ ID NO: 4762 - protein, 8 aa, Brucella spp.
SMSPMSAE

SEQ ID NO: 4763 - protein, 8 aa, Brucella spp.
KKSKVKQD

SEQ ID NO: 4764 - protein, 7 aa, Brucella spp.
ARSTKIK

SEQ ID NO: 4765 - protein, 12 aa, Brucella spp.
PPGVGKTSLARS

SEQ ID NO: 4766 - protein, 8 aa, Brucella spp.
IAKATGRE

SEQ ID NO: 4767 - protein, 10 aa, Brucella spp.
VRDEAEIRGH

SEQ ID NO: 4768 - protein, 8 aa, Brucella spp.
KKAKKSNP

SEQ ID NO: 4769 - protein, 10 aa, Brucella spp.
QDFRGDPSSA

SEQ ID NO: 4770 - protein, 6 aa, Brucella spp.
PKQNAT

SEQ ID NO: 4771 - protein, 7 aa, Brucella spp.
YTEDEKL

SEQ ID NO: 4772 - protein, 7 aa, Brucella spp.
ALQPKEF

SEQ ID NO: 4773 - protein, 5 aa, Brucella spp.
AGVRS

SEQ ID NO: 4774 - protein, 11 aa, Brucella spp.
KKKSVKITDKN

SEQ ID NO: 4775 - protein, 6 aa, Brucella spp.
DGEDQV

SEQ ID NO: 4776 - protein, 4 aa, Brucella spp.
MTVT

SEQ ID NO: 4777 - protein, 8 aa, Brucella spp.
ISAAASYV

SEQ ID NO: 4778 - protein, 12 aa, Brucella spp.
EGATPKDGPSAG

SEQ ID NO: 4779 - protein, 15 aa, Brucella spp.
PEENAKDLAEIPDNV

SEQ ID NO: 4780 - protein, 4 aa, Brucella spp.
QPEP

SEQ ID NO: 4781 - protein, 21 aa, Brucella spp.
EQENPTAVPPVEDEAGASLAH

SEQ ID NO: 4782 - protein, 4 aa, Brucella spp.
REHN

SEQ ID NO: 4783 - protein, 9 aa, Brucella spp.
LSGSGKSSL

SEQ ID NO: 4784 - protein, 5 aa, Brucella spp.
EGQRR

SEQ ID NO: 4785 - protein, 5 aa, Brucella spp.
DVDQI

SEQ ID NO: 4786 - protein, 15 aa, Brucella spp.
EQKTTSRNPRSTVGT

SEQ ID NO: 4787 - protein, 15 aa, Brucella spp.
PYSPATGLPIESQTV

SEQ ID NO: 4788 - protein, 9 aa, Brucella spp.
GRKGEYRKE

SEQ ID NO: 4789 - protein, 5 aa, Brucella spp.
KKGFQ

SEQ ID NO: 4790 - protein, 5 aa, Brucella spp.
PPLDK

SEQ ID NO: 4791 - protein, 22 aa, Brucella spp.
KPLPVGETAEGGSANKSANETH

SEQ ID NO: 4792 - protein, 8 aa, Brucella spp.
GLGTQQAI

SEQ ID NO: 4793 - protein, 9 aa, Brucella spp.
ESAALKDGA

SEQ ID NO: 4794 - protein, 14 aa, Brucella spp.
VAPWARSSSPYYNQ

SEQ ID NO: 4795 - protein, 7 aa, Brucella spp.
ELSEEAR

SEQ ID NO: 4796 - protein, 4 aa, Brucella spp.
TKGR

SEQ ID NO: 4797 - protein, 9 aa, Brucella spp.
RSYQTTKPF

SEQ ID NO: 4798 - protein, 10 aa, Brucella spp.
KETDSAWSRE

SEQ ID NO: 4799 - protein, 4 aa, Brucella spp.
PCPA

SEQ ID NO: 4800 - protein, 10 aa, Brucella spp.
GSFNEKQREI

SEQ ID NO: 4801 - protein, 13 aa, Brucella spp.
RNSGTLSGGESQR

SEQ ID NO: 4802 - protein, 5 aa, Brucella spp.
IGSGL

SEQ ID NO: 4803 - protein, 6 aa, Brucella spp.
AAGVHG

SEQ ID NO: 4804 - protein, 8 aa, Brucella spp.
AQGSPQDI

SEQ ID NO: 4805 - protein, 7 aa, Brucella spp.
TNSLTGK

SEQ ID NO: 4806 - protein, 10 aa, Brucella spp.
AERRKISKTK

SEQ ID NO: 4807 - protein, 8 aa, Brucella spp.
RGNNLKNV

SEQ ID NO: 4808 - protein, 10 aa, Brucella spp.
TGVSGGGKST

SEQ ID NO: 4809 - protein, 9 aa, Brucella spp.
SREHPAEHD

SEQ ID NO: 4810 - protein, 17 aa, Brucella spp.
QSPIGRTPRSNPATYTG

SEQ ID NO: 4811 - protein, 11 aa, Brucella spp.
PEAKARGYQPG

SEQ ID NO: 4812 - protein, 7 aa, Brucella spp.
RCEACQG

SEQ ID NO: 4813 - protein, 5 aa, Brucella spp.
RYNRE

SEQ ID NO: 4814 - protein, 13 aa, Brucella spp.
QQATTLSGGEAQR

SEQ ID NO: 4815 - protein, 9 aa, Brucella spp.
ELSRRATGR

SEQ ID NO: 4816 - protein, 10 aa, Brucella spp.
GPEGGDGGGE

SEQ ID NO: 4817 - protein, 5 aa, Brucella spp.
RPEDI

SEQ ID NO: 4818 - protein, 7 aa, Brucella spp.
EKRSYTG

SEQ ID NO: 4819 - protein, 7 aa, Brucella spp.
GADPEIR

SEQ ID NO: 4820 - protein, 18 aa, Brucella spp.
TSESWRDRQTGERKDRTE

SEQ ID NO: 4821 - protein, 14 aa, Brucella spp.
RKWQDQNGNDRYST

SEQ ID NO: 4822 - protein, 53 aa, Brucella spp.
SRSEGSEGRSFGGGGNRNQMSDYSGGGGDFGSSGPSSGSSGGFSRDLDDEIPF

SEQ ID NO: 4823 - protein, 8 aa, Brucella spp.
MSRHERGQ

SEQ ID NO: 4824 - protein, 12 aa, Brucella spp.
RTERKEKSAEVA

SEQ ID NO: 4825 - protein, 4 aa, Brucella spp.
GPGA

SEQ ID NO: 4826 - protein, 7 aa, Brucella spp.
SFPSVGS

SEQ ID NO: 4827 - protein, 4 aa, Brucella spp.
ETGR

SEQ ID NO: 4828 - protein, 4 aa, Brucella spp.
PDVR

SEQ ID NO: 4829 - protein, 8 aa, Brucella spp.
RPYRKSAG

SEQ ID NO: 4830 - protein, 6 aa, Brucella spp.
HPHGDA

SEQ ID NO: 4831 - protein, 16 aa, Brucella spp.
GQGNFGSIDGDPPAAM

SEQ ID NO: 4832 - protein, 6 aa, Brucella spp.
KDTVNF

SEQ ID NO: 4833 - protein, 10 aa, Brucella spp.
DNYDGREQEP

SEQ ID NO: 4834 - protein, 5 aa, Brucella spp.
GSGGI

SEQ ID NO: 4835 - protein, 5 aa, Brucella spp.
IPPHN

SEQ ID NO: 4836 - protein, 6 aa, Brucella spp.
GPDFPT

SEQ ID NO: 4837 - protein, 10 aa, Brucella spp.
INSAYTTGRG

SEQ ID NO: 4838 - protein, 7 aa, Brucella spp.
IEPMRGD

SEQ ID NO: 4839 - protein, 11 aa, Brucella spp.
DLRDESDREGY

SEQ ID NO: 4840 - protein, 8 aa, Brucella spp.
NGGKPEQL

SEQ ID NO: 4841 - protein, 9 aa, Brucella spp.
APDPATARE

SEQ ID NO: 4842 - protein, 19 aa, Brucella spp.
PRHTLNEDNTYNLSEEQAR

SEQ ID NO: 4843 - protein, 8 aa, Brucella spp.
GRDEVADE

SEQ ID NO: 4844 - protein, 4 aa, Brucella spp.
IGEE

SEQ ID NO: 4845 - protein, 8 aa, Brucella spp.
FATPRRTE

SEQ ID NO: 4846 - protein, 7 aa, Brucella spp.
GAEMDDE

SEQ ID NO: 4847 - protein, 18 aa, Brucella spp.
AQRRGGKGRSGMATKEED

SEQ ID NO: 4848 - protein, 8 aa, Brucella spp.
GTPQSRGK

SEQ ID NO: 4849 - protein, 4 aa, Brucella spp.
QGER

SEQ ID NO: 4850 - protein, 7 aa, Brucella spp.
PEDEDSW

SEQ ID NO: 4851 - protein, 8 aa, Brucella spp.
TRGTVRRN

SEQ ID NO: 4852 - protein, 6 aa, Brucella spp.
EDEGDE

SEQ ID NO: 4853 - protein, 8 aa, Brucella spp.
ATPAERSA

SEQ ID NO: 4854 - protein, 12 aa, Brucella spp.
AERRAQGADDAD

SEQ ID NO: 4855 - protein, 14 aa, Brucella spp.
VDAEAELSEDRYQE

SEQ ID NO: 4856 - protein, 6 aa, Brucella spp.
KAREET

SEQ ID NO: 4857 - protein, 9 aa, Brucella spp.
YGKRSSSYE

SEQ ID NO: 4858 - protein, 19 aa, Brucella spp.
SGRGGKGIRATDTSKTDEI

SEQ ID NO: 4859 - protein, 8 aa, Brucella spp.
AGRSTKGV

SEQ ID NO: 4860 - protein, 6 aa, Brucella spp.
ADGEKV

SEQ ID NO: 4861 - protein, 28 aa, Brucella spp.
ISDADSDEENGNGGDAAPEGDTPAATQE

SEQ ID NO: 4862 - protein, 8 aa, Brucella spp.
NASKRQRV

SEQ ID NO: 4863 - protein, 4 aa, Brucella spp.
PGKK

SEQ ID NO: 4864 - protein, 5 aa, Brucella spp.
RKHGA

SEQ ID NO: 4865 - protein, 6 aa, Brucella spp.
RDGTDL

SEQ ID NO: 4866 - protein, 5 aa, Brucella spp.
GTMAP

SEQ ID NO: 4867 - protein, 6 aa, Brucella spp.
PGEPFE

SEQ ID NO: 4868 - protein, 10 aa, Brucella spp.
MRERTGNISQ

SEQ ID NO: 4869 - protein, 8 aa, Brucella spp.
KRVKEGDR

SEQ ID NO: 4870 - protein, 10 aa, Brucella spp.
TVAEKGDSGE

SEQ ID NO: 4871 - protein, 15 aa, Brucella spp.
SKRPEDERDRKDYQT

SEQ ID NO: 4872 - protein, 11 aa, Brucella spp.
REEGAVAAPTA

SEQ ID NO: 4873 - protein, 8 aa, Brucella spp.
ADDTGDHK

SEQ ID NO: 4874 - protein, 7 aa, Brucella spp.
SQRTASA

SEQ ID NO: 4875 - protein, 4 aa, Brucella spp.
HERG

SEQ ID NO: 4876 - protein, 8 aa, Brucella spp.
SATGEDGV

SEQ ID NO: 4877 - protein, 4 aa, Brucella spp.
PWSG

SEQ ID NO: 4878 - protein, 8 aa, Brucella spp.
QPAQTVST

SEQ ID NO: 4879 - protein, 7 aa, Brucella spp.
IGTASAL

SEQ ID NO: 4880 - protein, 7 aa, Brucella spp.
ANQDVKQ

SEQ ID NO: 4881 - protein, 5 aa, Brucella spp.
AAAEA

SEQ ID NO: 4882 - protein, 12 aa, Brucella spp.
LKRADTLRTRGV

SEQ ID NO: 4883 - protein, 11 aa, Brucella spp.
SNVDTTAMPAN

SEQ ID NO: 4884 - protein, 11 aa, Brucella spp.
TLAQKSVKAPF

SEQ ID NO: 4885 - protein, 11 aa, Brucella spp.
VKVGSNADTLD

SEQ ID NO: 4886 - protein, 7 aa, Brucella spp.
PKIDPTT

SEQ ID NO: 4887 - protein, 12 aa, Brucella spp.
EVDNPDHKLTPG

SEQ ID NO: 4888 - protein, 5 aa, Brucella spp.
LPEES

SEQ ID NO: 4889 - protein, 23 aa, Brucella spp.
PEQKQESAKASEAAKVQEGQKQV

SEQ ID NO: 4890 - protein, 16 aa, Brucella spp.
RRSAGNVEVTSGLKPG

SEQ ID NO: 4891 - protein, 8 aa, Brucella spp.
QNRLSSGV

SEQ ID NO: 4892 - protein, 13 aa, Brucella spp.
NTVNPSGNPADRQ

SEQ ID NO: 4893 - protein, 5 aa, Brucella spp.
LTEDE

SEQ ID NO: 4894 - protein, 4 aa, Brucella spp.
KAFA

SEQ ID NO: 4895 - protein, 7 aa, Brucella spp.
LEETTDP

SEQ ID NO: 4896 - protein, 9 aa, Brucella spp.
EDYGAANAS

SEQ ID NO: 4897 - protein, 5 aa, Brucella spp.
RIDSG

SEQ ID NO: 4898 - protein, 9 aa, Brucella spp.
GSDEQRKKY

SEQ ID NO: 4899 - protein, 25 aa, Brucella spp.
EPDAGSDPAGMKTRAEKIDGGYRLS

SEQ ID NO: 4900 - protein, 6 aa, Brucella spp.
AAHDNA

SEQ ID NO: 4901 - protein, 11 aa, Brucella spp.
KGLSAPKIGGK

SEQ ID NO: 4902 - protein, 9 aa, Brucella spp.
NKPLAGTQL

SEQ ID NO: 4903 - protein, 5 aa, Brucella spp.
NNCGK

SEQ ID NO: 4904 - protein, 8 aa, Brucella spp.
RDMHGGNG

SEQ ID NO: 4905 - protein, 7 aa, Brucella spp.
NTYEGTH

SEQ ID NO: 4906 - protein, 6 aa, Brucella spp.
KAVEEG

SEQ ID NO: 4907 - protein, 5 aa, Brucella spp.
DARDG

SEQ ID NO: 4908 - protein, 9 aa, Brucella spp.
KKGETSGNL

SEQ ID NO: 4909 - protein, 9 aa, Brucella spp.
GDGPTCHTG

SEQ ID NO: 4910 - protein, 5 aa, Brucella spp.
SSGGK

SEQ ID NO: 4911 - protein, 6 aa, Brucella spp.
TSLPVN

SEQ ID NO: 4912 - protein, 11 aa, Brucella spp.
KKPGKAEAEAA

SEQ ID NO: 4913 - protein, 8 aa, Brucella spp.
EDPDREGL

SEQ ID NO: 4914 - protein, 7 aa, Brucella spp.
ETPKRVA

SEQ ID NO: 4915 - protein, 8 aa, Brucella spp.
YSESPEEV

SEQ ID NO: 4916 - protein, 7 aa, Brucella spp.
QTQESIT

SEQ ID NO: 4917 - protein, 11 aa, Brucella spp.
RKQGSSTITTT

SEQ ID NO: 4918 - protein, 17 aa, Brucella spp.
FKEKADQQVRFMTLIRT

SEQ ID NO: 4919 - protein, 9 aa, Brucella spp.
GAPKPYSRN

SEQ ID NO: 4920 - protein, 10 aa, Brucella spp.
DPWRKTPGRL

SEQ ID NO: 4921 - protein, 6 aa, Brucella spp.
VPRELS

SEQ ID NO: 4922 - protein, 14 aa, Brucella spp.
PDGSVREYDASMTG

SEQ ID NO: 4923 - protein, 10 aa, Brucella spp.
ESISKSLAKK

SEQ ID NO: 4924 - protein, 4 aa, Brucella spp.
TVRD

SEQ ID NO: 4925 - protein, 8 aa, Brucella spp.
SDPLGASG

SEQ ID NO: 4926 - protein, 5 aa, Brucella spp.
REDPR

SEQ ID NO: 4927 - protein, 4 aa, Brucella spp.
KPFT

SEQ ID NO: 4928 - protein, 17 aa, Brucella spp.
SREKAKQVFSDKGESYK

SEQ ID NO: 4929 - protein, 5 aa, Brucella spp.
IPAGQ

SEQ ID NO: 4930 - protein, 9 aa, Brucella spp.
MASTGQIGN

SEQ ID NO: 4931 - protein, 7 aa, Brucella spp.
GDANNPM

SEQ ID NO: 4932 - protein, 5 aa, Brucella spp.
ANDND

SEQ ID NO: 4933 - protein, 9 aa, Brucella spp.
AEKRDHRRL

SEQ ID NO: 4934 - protein, 4 aa, Brucella spp.
EEGP

SEQ ID NO: 4935 - protein, 12 aa, Brucella spp.
SHGYQEVNTPQV

SEQ ID NO: 4936 - protein, 9 aa, Brucella spp.
AGDDTDDDR

SEQ ID NO: 4937 - protein, 5 aa, Brucella spp.
YEPSG

SEQ ID NO: 4938 - protein, 12 aa, Brucella spp.
STRPEKRVGSDE

SEQ ID NO: 4939 - protein, 8 aa, Brucella spp.
RQQSNNIK

SEQ ID NO: 4940 - protein, 8 aa, Brucella spp.
ADSEKKQP

SEQ ID NO: 4941 - protein, 17 aa, Brucella spp.
TSDADEYAKEAAAKLKA

SEQ ID NO: 4942 - protein, 8 aa, Brucella spp.
REAEEKTV

SEQ ID NO: 4943 - protein, 9 aa, Brucella spp.
GSRDQESMT

SEQ ID NO: 4944 - protein, 14 aa, Brucella spp.
EATPPDLLRLKNAG

SEQ ID NO: 4945 - protein, 6 aa, Brucella spp.
PGKRLR

SEQ ID NO: 4946 - protein, 17 aa, Brucella spp.
QGVDPTAGTGLSLPEPK

SEQ ID NO: 4947 - protein, 13 aa, Brucella spp.
NPYASPASPENNP

SEQ ID NO: 4948 - protein, 10 aa, Brucella spp.
KLTQEGGDIP

SEQ ID NO: 4949 - protein, 7 aa, Brucella spp.
DVGPDGQ

SEQ ID NO: 4950 - protein, 13 aa, Brucella spp.
SSKGGSASFNLPE

SEQ ID NO: 4951 - protein, 9 aa, Brucella spp.
RAGATKRIT

SEQ ID NO: 4952 - protein, 5 aa, Brucella spp.
LSNSA

SEQ ID NO: 4953 - protein, 8 aa, Brucella spp.
LPGNGKIK

SEQ ID NO: 4954 - protein, 8 aa, Brucella spp.
DEENSDRS

SEQ ID NO: 4955 - protein, 8 aa, Brucella spp.
GKLTEATV

SEQ ID NO: 4956 - protein, 9 aa, Brucella spp.
HGGEALADT

SEQ ID NO: 4957 - protein, 11 aa, Brucella spp.
GDVVRESAGAY

SEQ ID NO: 4958 - protein, 6 aa, Brucella spp.
NKDRIY

SEQ ID NO: 4959 - protein, 9 aa, Brucella spp.
VESGKNEDV

SEQ ID NO: 4960 - protein, 12 aa, Brucella spp.
NSDSEASDDIVD

SEQ ID NO: 4961 - protein, 6 aa, Brucella spp.
NPETGC

SEQ ID NO: 4962 - protein, 4 aa, Brucella spp.
RDDM

SEQ ID NO: 4963 - protein, 12 aa, Brucella spp.
AQARSAGMAKGS

SEQ ID NO: 4964 - protein, 13 aa, Brucella spp.
KAEEKAERAERRA

SEQ ID NO: 4965 - protein, 5 aa, Brucella spp.
QKAAK

SEQ ID NO: 4966 - protein, 6 aa, Brucella spp.
EETAEL

SEQ ID NO: 4967 - protein, 13 aa, Brucella spp.
AMAASDKAEIEEE

SEQ ID NO: 4968 - protein, 12 aa, Brucella spp.
KTSGRDLDAASL

SEQ ID NO: 4969 - protein, 4 aa, Brucella spp.
QSPF

SEQ ID NO: 4970 - protein, 5 aa, Brucella spp.
SASAS

SEQ ID NO: 4971 - protein, 6 aa, Brucella spp.
GGGGIS

SEQ ID NO: 4972 - protein, 7 aa, Brucella spp.
KKSLASG

SEQ ID NO: 4973 - protein, 9 aa, Brucella spp.
TRAGDAKAV

SEQ ID NO: 4974 - protein, 5 aa, Brucella spp.
AATDP

SEQ ID NO: 4975 - protein, 6 aa, Brucella spp.
SNQIGP

SEQ ID NO: 4976 - protein, 16 aa, Brucella spp.
ESGGIIPTTSVGNSAS

SEQ ID NO: 4977 - protein, 9 aa, Brucella spp.
TKRPSRDPI

SEQ ID NO: 4978 - protein, 15 aa, Brucella spp.
QENDSASPVEPADHE

SEQ ID NO: 4979 - protein, 10 aa, Brucella spp.
FASGSSITLS

SEQ ID NO: 4980 - protein, 5 aa, Brucella spp.
EISNH

SEQ ID NO: 4981 - protein, 7 aa, Brucella spp.
NSTHVDG

SEQ ID NO: 4982 - protein, 9 aa, Brucella spp.
IGGSGDFAR

SEQ ID NO: 4983 - protein, 9 aa, Brucella spp.
KSEAKNGAI

SEQ ID NO: 4984 - protein, 6 aa, Brucella spp.
LAPRER

SEQ ID NO: 4985 - protein, 4 aa, Brucella spp.
PDYR

SEQ ID NO: 4986 - protein, 7 aa, Brucella spp.
KRGGHTP

SEQ ID NO: 4987 - protein, 9 aa, Brucella spp.
RSPLSVPVP

SEQ ID NO: 4988 - protein, 5 aa, Brucella spp.
SDAEV

SEQ ID NO: 4989 - protein, 5 aa, Brucella spp.
AKPDT

SEQ ID NO: 4990 - protein, 6 aa, Brucella spp.
AHSPQK

SEQ ID NO: 4991 - protein, 7 aa, Brucella spp.
TLDSPRA

SEQ ID NO: 4992 - protein, 12 aa, Brucella spp.
AGRNGQEEYEKA

SEQ ID NO: 4993 - protein, 14 aa, Brucella spp.
IADKESGLPHTLPS

SEQ ID NO: 4994 - protein, 8 aa, Brucella spp.
AGYPVTDE

SEQ ID NO: 4995 - protein, 11 aa, Brucella spp.
EKRSQIADARG

SEQ ID NO: 4996 - protein, 15 aa, Brucella spp.
VGRFTGRDAEPRAGM

SEQ ID NO: 4997 - protein, 7 aa, Brucella spp.
SGHMPGA

SEQ ID NO: 4998 - protein, 9 aa, Brucella spp.
LSENGELKD

SEQ ID NO: 4999 - protein, 5 aa, Brucella spp.
CGSGV

SEQ ID NO: 5000 - protein, 8 aa, Brucella spp.
GHKDNRLY

SEQ ID NO: 5001 - protein, 17 aa, Brucella spp.
SEWGSRQDTPVVTGEAE

SEQ ID NO: 5002 - protein, 6 aa, Brucella spp.
LSTAEG

SEQ ID NO: 5003 - protein, 11 aa, Brucella spp.
ATSGGQPGDTG

SEQ ID NO: 5004 - protein, 6 aa, Brucella spp.
ADGSRI

SEQ ID NO: 5005 - protein, 8 aa, Brucella spp.
TVTGETKN

SEQ ID NO: 5006 - protein, 8 aa, Brucella spp.
QGQQMPDV

SEQ ID NO: 5007 - protein, 8 aa, Brucella spp.
AVGEDESR

SEQ ID NO: 5008 - protein, 11 aa, Brucella spp.
PDQSYTKESVT

SEQ ID NO: 5009 - protein, 8 aa, Brucella spp.
KNVRPPVG

SEQ ID NO: 5010 - protein, 21 aa, Brucella spp.
ENGSVDSQPCGGTHVSETQEV

SEQ ID NO: 5011 - protein, 9 aa, Brucella spp.
EKKGKENRR

SEQ ID NO: 5012 - protein, 5 aa, Brucella spp.
ASELT

SEQ ID NO: 5013 - protein, 10 aa, Brucella spp.
LNPGQSVKDR

SEQ ID NO: 5014 - protein, 5 aa, Brucella spp.
KRGLL

SEQ ID NO: 5015 - protein, 8 aa, Brucella spp.
GTAGNTGI

SEQ ID NO: 5016 - protein, 9 aa, Brucella spp.
ETQSQEKKE

SEQ ID NO: 5017 - protein, 8 aa, Brucella spp.
APYRNPNN

SEQ ID NO: 5018 - protein, 9 aa, Brucella spp.
LAKTEPNGA

SEQ ID NO: 5019 - protein, 4 aa, Brucella spp.
NTVN

SEQ ID NO: 5020 - protein, 5 aa, Brucella spp.
HIETT

SEQ ID NO: 5021 - protein, 6 aa, Brucella spp.
DTSDQI

SEQ ID NO: 5022 - protein, 9 aa, Brucella spp.
GSGGTLAGT

SEQ ID NO: 5023 - protein, 4 aa, Brucella spp.
DPHG

SEQ ID NO: 5024 - protein, 18 aa, Brucella spp.
ELKAEGDSITEGIGQGRI

SEQ ID NO: 5025 - protein, 6 aa, Brucella spp.
GSSGIN

SEQ ID NO: 5026 - protein, 6 aa, Brucella spp.
DLGPGH

SEQ ID NO: 5027 - protein, 4 aa, Brucella spp.
AEKA

SEQ ID NO: 5028 - protein, 4 aa, Brucella spp.
LTPV

SEQ ID NO: 5029 - protein, 7 aa, Brucella spp.
VETTDKN

SEQ ID NO: 5030 - protein, 5 aa, Brucella spp.
GNHAQ

SEQ ID NO: 5031 - protein, 13 aa, Brucella spp.
TPQQKIDKTRTFG

SEQ ID NO: 5032 - protein, 5 aa, Brucella spp.
EFAAA

SEQ ID NO: 5033 - protein, 9 aa, Brucella spp.
QLPDDSKPD

SEQ ID NO: 5034 - protein, 10 aa, Brucella spp.
GGGGLSSGVT

SEQ ID NO: 5035 - protein, 14 aa, Brucella spp.
QGAASLKASLEAGK

SEQ ID NO: 5036 - protein, 5 aa, Brucella spp.
AEIGK

SEQ ID NO: 5037 - protein, 7 aa, Brucella spp.
KKSDIKG

SEQ ID NO: 5038 - protein, 4 aa, Brucella spp.
PDDD

SEQ ID NO: 5039 - protein, 5 aa, Brucella spp.
SARNF

SEQ ID NO: 5040 - protein, 4 aa, Brucella spp.
TRDA

SEQ ID NO: 5041 - protein, 4 aa, Brucella spp.
AESG

SEQ ID NO: 5042 - protein, 13 aa, Brucella spp.
AAAEGAREGGAEV

SEQ ID NO: 5043 - protein, 11 aa, Brucella spp.
EAPIATPGELA

SEQ ID NO: 5044 - protein, 7 aa, Brucella spp.
ATQHGGA

SEQ ID NO: 5045 - protein, 31 aa, Brucella spp.
RGGAPYGMTTTADGDGSRQPSAQELDGARFQ

SEQ ID NO: 5046 - protein, 4 aa, Brucella spp.
QSAY

SEQ ID NO: 5047 - protein, 11 aa, Brucella spp.
ATSEIKNPDGS

SEQ ID NO: 5048 - protein, 5 aa, Brucella spp.
EENDV

SEQ ID NO: 5049 - protein, 17 aa, Brucella spp.
DEDALSKLPEGERYGSE

SEQ ID NO: 5050 - protein, 6 aa, Brucella spp.
FDSEED

SEQ ID NO: 5051 - protein, 8 aa, Brucella spp.
RVAPNSPQ

SEQ ID NO: 5052 - protein, 7 aa, Brucella spp.
IDGPGQG

SEQ ID NO: 5053 - protein, 14 aa, Brucella spp.
GKLTKSKSAYEHPQ

SEQ ID NO: 5054 - protein, 9 aa, Brucella spp.
YGSGTGSNF

SEQ ID NO: 5055 - protein, 15 aa, Brucella spp.
RGEGEKLSGGGKSSG

SEQ ID NO: 5056 - protein, 16 aa, Brucella spp.
DRAAGAIKSGGTTRRA

SEQ ID NO: 5057 - protein, 6 aa, Brucella spp.
KEEQKV

SEQ ID NO: 5058 - protein, 18 aa, Brucella spp.
EADKDDCFDPAKNPALKR

SEQ ID NO: 5059 - protein, 12 aa, Brucella spp.
IKAAKKNQVPEN

SEQ ID NO: 5060 - protein, 6 aa, Brucella spp.
DTDWDS

SEQ ID NO: 5061 - protein, 11 aa, Brucella spp.
SGQNSNNSVSL

SEQ ID NO: 5062 - protein, 5 aa, Brucella spp.
NDGDW

SEQ ID NO: 5063 - protein, 6 aa, Brucella spp.
ARRDGR

SEQ ID NO: 5064 - protein, 8 aa, Brucella spp.
ASADPGLH

SEQ ID NO: 5065 - protein, 11 aa, Brucella spp.
SAGPIRASNPC

SEQ ID NO: 5066 - protein, 6 aa, Brucella spp.
NKDGSF

SEQ ID NO: 5067 - protein, 11 aa, Brucella spp.
IPYDSKEGRAI

SEQ ID NO: 5068 - protein, 5 aa, Brucella spp.
TSAEM

SEQ ID NO: 5069 - protein, 9 aa, Brucella spp.
TFPSYEPNA

SEQ ID NO: 5070 - protein, 12 aa, Brucella spp.
RAAHGERQGYEG

SEQ ID NO: 5071 - protein, 9 aa, Brucella spp.
GEKHGYRNA

SEQ ID NO: 5072 - protein, 5 aa, Brucella spp.
APTGT

SEQ ID NO: 5073 - protein, 6 aa, Brucella spp.
TTGIEP

SEQ ID NO: 5074 - protein, 5 aa, Brucella spp.
LAGGG

SEQ ID NO: 5075 - protein, 6 aa, Brucella spp.
YSESQI

SEQ ID NO: 5076 - protein, 22 aa, Brucella spp.
NLNQAPGVNPSSLKSKGFTDEK

SEQ ID NO: 5077 - protein, 5 aa, Brucella spp.
KDIEA

SEQ ID NO: 5078 - protein, 11 aa, Brucella spp.
INMPNEATVED

SEQ ID NO: 5079 - protein, 13 aa, Brucella spp.
LYRDGSKLSQPLN

SEQ ID NO: 5080 - protein, 9 aa, Brucella spp.
ADDEDEDDA

SEQ ID NO: 5081 - protein, 6 aa, Brucella spp.
PAAARA

SEQ ID NO: 5082 - protein, 13 aa, Brucella spp.
EKLPNRRQGYTQK

SEQ ID NO: 5083 - protein, 6 aa, Brucella spp.
EFGDGR

SEQ ID NO: 5084 - protein, 5 aa, Brucella spp.
IKTAT

SEQ ID NO: 5085 - protein, 10 aa, Brucella spp.
DTSDFGNTAL

SEQ ID NO: 5086 - protein, 11 aa, Brucella spp.
GKGIKEGKTNL

SEQ ID NO: 5087 - protein, 5 aa, Brucella spp.
RGYKP

SEQ ID NO: 5088 - protein, 35 aa, Brucella spp.
TLPGNEAKGSVNSAPQASNVTTLKSSGPAANRPAT

SEQ ID NO: 5089 - protein, 4 aa, Brucella spp.
GATA

SEQ ID NO: 5090 - protein, 20 aa, Brucella spp.
FEEQQPAPAPLQESSAATEL

SEQ ID NO: 5091 - protein, 25 aa, Brucella spp.
KAAADAASARAESANAAKKLEADRR

SEQ ID NO: 5092 - protein, 9 aa, Brucella spp.
GYTGDSCSE

SEQ ID NO: 5093 - protein, 7 aa, Brucella spp.
VQAPGNP

SEQ ID NO: 5094 - protein, 7 aa, Brucella spp.
DHDTKTV

SEQ ID NO: 5095 - protein, 8 aa, Brucella spp.
SSATYHRP

SEQ ID NO: 5096 - protein, 7 aa, Brucella spp.
LRPAHGP

SEQ ID NO: 5097 - protein, 4 aa, Brucella spp.
AGPG

SEQ ID NO: 5098 - protein, 10 aa, Brucella spp.
RYGPGFSAQT

SEQ ID NO: 5099 - protein, 8 aa, Brucella spp.
KTDGRSQI

SEQ ID NO: 5100 - protein, 5 aa, Brucella spp.
YGTVT

SEQ ID NO: 5101 - protein, 7 aa, Brucella spp.
YSSGTAN

SEQ ID NO: 5102 - protein, 6 aa, Brucella spp.
ENGKEA

SEQ ID NO: 5103 - protein, 7 aa, Brucella spp.
SGTFAGS

SEQ ID NO: 5104 - protein, 10 aa, Brucella spp.
KPSQASLGRY

SEQ ID NO: 5105 - protein, 10 aa, Brucella spp.
VRAGTEGIPK

SEQ ID NO: 5106 - protein, 9 aa, Brucella spp.
LTPSRTGYN

SEQ ID NO: 5107 - protein, 4 aa, Brucella spp.
ARET

SEQ ID NO: 5108 - protein, 21 aa, Brucella spp.
QQENANHPDLADRASSETDRA

SEQ ID NO: 5109 - protein, 6 aa, Brucella spp.
ARDRQR

SEQ ID NO: 5110 - protein, 6 aa, Brucella spp.
RLDDGT

SEQ ID NO: 5111 - protein, 7 aa, Brucella spp.
ETGDPIS

SEQ ID NO: 5112 - protein, 15 aa, Brucella spp.
AQERHERREKVYRDD

SEQ ID NO: 5113 - protein, 6 aa, Brucella spp.
TDRATG

SEQ ID NO: 5114 - protein, 7 aa, Brucella spp.
GLSRAGK

SEQ ID NO: 5115 - protein, 8 aa, Brucella spp.
EPQPDDAV

SEQ ID NO: 5116 - protein, 6 aa, Brucella spp.
DSTRAI

SEQ ID NO: 5117 - protein, 6 aa, Brucella spp.
NEPTYR

SEQ ID NO: 5118 - protein, 14 aa, Brucella spp.
KTVAPSEKADELTA

SEQ ID NO: 5119 - protein, 14 aa, Brucella spp.
AGKADERALSTLPP

SEQ ID NO: 5120 - protein, 7 aa, Brucella spp.
LDGSPAL

SEQ ID NO: 5121 - protein, 11 aa, Brucella spp.
DLEPGDFKSGS

SEQ ID NO: 5122 - protein, 4 aa, Brucella spp.
PGRS

SEQ ID NO: 5123 - protein, 6 aa, Brucella spp.
ADFSGA

SEQ ID NO: 5124 - protein, 14 aa, Brucella spp.
RTTREATVTEGNET

SEQ ID NO: 5125 - protein, 7 aa, Brucella spp.
LKGERID

SEQ ID NO: 5126 - protein, 6 aa, Brucella spp.
DGETET

SEQ ID NO: 5127 - protein, 7 aa, Brucella spp.
DLPKNPN

SEQ ID NO: 5128 - protein, 7 aa, Brucella spp.
LSQDEPA

SEQ ID NO: 5129 - protein, 9 aa, Brucella spp.
RLERTAEGV

SEQ ID NO: 5130 - protein, 7 aa, Brucella spp.
TDDEAAE

SEQ ID NO: 5131 - protein, 9 aa, Brucella spp.
FEAPERKGW

SEQ ID NO: 5132 - protein, 18 aa, Brucella spp.
KDAADAAERDDMAAARKA

SEQ ID NO: 5133 - protein, 9 aa, Brucella spp.
GIPETAKGR

SEQ ID NO: 5134 - protein, 7 aa, Brucella spp.
YGGRPGT

SEQ ID NO: 5135 - protein, 6 aa, Brucella spp.
AKLGEG

SEQ ID NO: 5136 - protein, 7 aa, Brucella spp.
EKRPGIG

SEQ ID NO: 5137 - protein, 7 aa, Brucella spp.
QWSGPGE

SEQ ID NO: 5138 - protein, 5 aa, Brucella spp.
KYKGT

SEQ ID NO: 5139 - protein, 9 aa, Brucella spp.
GTTPDDTVG

SEQ ID NO: 5140 - protein, 30 aa, Brucella spp.
TRVGDGYAGKFNDGADGKGLDVTSGSVNGN

SEQ ID NO: 5141 - protein, 6 aa, Brucella spp.
SDPNTM

SEQ ID NO: 5142 - protein, 7 aa, Brucella spp.
GRSDTRV

SEQ ID NO: 5143 - protein, 9 aa, Brucella spp.
RTPPWGKTD

SEQ ID NO: 5144 - protein, 6 aa, Brucella spp.
ETGRAI

SEQ ID NO: 5145 - protein, 6 aa, Brucella spp.
PSLPVG

SEQ ID NO: 5146 - protein, 17 aa, Brucella spp.
DRAEMEKARTDAGWWLE

SEQ ID NO: 5147 - protein, 7 aa, Brucella spp.
EQISRAA

SEQ ID NO: 5148 - protein, 16 aa, Brucella spp.
AEQQAKAAEPVGNEPV

SEQ ID NO: 5149 - protein, 10 aa, Brucella spp.
ATPAAPPVPP

SEQ ID NO: 5150 - protein, 18 aa, Brucella spp.
AASSAPAIAANTEHKPAN

SEQ ID NO: 5151 - protein, 49 aa, Brucella spp.
PVSAQETAAKPAAAVATATPVATPVRAPANDDSRSDKAIAAAPRRITEH

SEQ ID NO: 5152 - protein, 13 aa, Brucella spp.
AQEMQNAARSMTD

SEQ ID NO: 5153 - protein, 11 aa, Brucella spp.
EAVAGDRVSTL

SEQ ID NO: 5154 - protein, 8 aa, Brucella spp.
ERAYSDNE

SEQ ID NO: 5155 - protein, 7 aa, Brucella spp.
LGNEREA

SEQ ID NO: 5156 - protein, 12 aa, Brucella spp.
RVRSSISGAHEQ

SEQ ID NO: 5157 - protein, 10 aa, Brucella spp.
REELSSASNI

SEQ ID NO: 5158 - protein, 5 aa, Brucella spp.
SASQQ

SEQ ID NO: 5159 - protein, 6 aa, Brucella spp.
GDSGER

SEQ ID NO: 5160 - protein, 8 aa, Brucella spp.
NESGGAIA

SEQ ID NO: 5161 - protein, 17 aa, Brucella spp.
EKRTGDIGNRITTSGEA

SEQ ID NO: 5162 - protein, 10 aa, Brucella spp.
DEQSRTISGK

SEQ ID NO: 5163 - protein, 9 aa, Brucella spp.
QALDERTTG

SEQ ID NO: 5164 - protein, 5 aa, Brucella spp.
SATQT

SEQ ID NO: 5165 - protein, 8 aa, Brucella spp.
NTLSDRGR

SEQ ID NO: 5166 - protein, 9 aa, Brucella spp.
ALDNSTEKL

SEQ ID NO: 5167 - protein, 9 aa, Brucella spp.
ALETRSRQI

SEQ ID NO: 5168 - protein, 10 aa, Brucella spp.
ETFSGGRNSL

SEQ ID NO: 5169 - protein, 9 aa, Brucella spp.
DDLTSISES

SEQ ID NO: 5170 - protein, 9 aa, Brucella spp.
FEGKLAESR

SEQ ID NO: 5171 - protein, 8 aa, Brucella spp.
LEGETERV

SEQ ID NO: 5172 - protein, 9 aa, Brucella spp.
LAARTGDIQ

SEQ ID NO: 5173 - protein, 15 aa, Brucella spp.
NAIDASASALNEVTD

SEQ ID NO: 5174 - protein, 9 aa, Brucella spp.
RTSALQQAM

SEQ ID NO: 5175 - protein, 8 aa, Brucella spp.
RSLEERTA

SEQ ID NO: 5176 - protein, 5 aa, Brucella spp.
FNENR

SEQ ID NO: 5177 - protein, 5 aa, Brucella spp.
ENQSA

SEQ ID NO: 5178 - protein, 15 aa, Brucella spp.
ARNMAESLGAGRDAF

SEQ ID NO: 5179 - protein, 8 aa, Brucella spp.
VEERTSGL

SEQ ID NO: 5180 - protein, 8 aa, Brucella spp.
EQTIETRA

SEQ ID NO: 5181 - protein, 16 aa, Brucella spp.
RSTLTDSTASLSQTLQ

SEQ ID NO: 5182 - protein, 7 aa, Brucella spp.
QRTTSLQ

SEQ ID NO: 5183 - protein, 18 aa, Brucella spp.
AIANSSAAISSAFEGQTG

SEQ ID NO: 5184 - protein, 7 aa, Brucella spp.
ERTETME

SEQ ID NO: 5185 - protein, 6 aa, Brucella spp.
LEQSAG

SEQ ID NO: 5186 - protein, 26 aa, Brucella spp.
EKIGEAASTLAAEAAKAGEALDGFGE

SEQ ID NO: 5187 - protein, 15 aa, Brucella spp.
LSGTEARLGERADAI

SEQ ID NO: 5188 - protein, 21 aa, Brucella spp.
ADTAAKTSETLASHSESFSAS

SEQ ID NO: 5189 - protein, 9 aa, Brucella spp.
DNLAGTETR

SEQ ID NO: 5190 - protein, 6 aa, Brucella spp.
VTDTTA

SEQ ID NO: 5191 - protein, 6 aa, Brucella spp.
EERTRE

SEQ ID NO: 5192 - protein, 5 aa, Brucella spp.
RSQEI

SEQ ID NO: 5193 - protein, 5 aa, Brucella spp.
DTAEP

SEQ ID NO: 5194 - protein, 9 aa, Brucella spp.
ADSGRGLAQ

SEQ ID NO: 5195 - protein, 16 aa, Brucella spp.
EEATHAATDRLRSENA

SEQ ID NO: 5196 - protein, 6 aa, Brucella spp.
SRTAET

SEQ ID NO: 5197 - protein, 6 aa, Brucella spp.
VGLSDN

SEQ ID NO: 5198 - protein, 7 aa, Brucella spp.
ASNGELG

SEQ ID NO: 5199 - protein, 4 aa, Brucella spp.
TRNL

SEQ ID NO: 5200 - protein, 5 aa, Brucella spp.
STTSF

SEQ ID NO: 5201 - protein, 7 aa, Brucella spp.
VENTNRA

SEQ ID NO: 5202 - protein, 6 aa, Brucella spp.
SDNTLS

SEQ ID NO: 5203 - protein, 14 aa, Brucella spp.
SSASDMINSAQNGL

SEQ ID NO: 5204 - protein, 8 aa, Brucella spp.
VEKSEGVE

SEQ ID NO: 5205 - protein, 17 aa, Brucella spp.
QRAEGQTRVSAEKMRES

SEQ ID NO: 5206 - protein, 17 aa, Brucella spp.
QKFSAATDEIRRTASEI

SEQ ID NO: 5207 - protein, 8 aa, Brucella spp.
LDTTRGEL

SEQ ID NO: 5208 - protein, 10 aa, Brucella spp.
AEAKETTTAM

SEQ ID NO: 5209 - protein, 23 aa, Brucella spp.
GEGRADRPVSRPAASRPAPVQAP

SEQ ID NO: 5210 - protein, 4 aa, Brucella spp.
PLAQ

SEQ ID NO: 5211 - protein, 23 aa, Brucella spp.
SRPVEAPNQKPAPAASAEKPRGW

SEQ ID NO: 5212 - protein, 24 aa, Brucella spp.
ASREEEEAAQPKVQPAATPRSPSH

SEQ ID NO: 5213 - protein, 5 aa, Brucella spp.
RGERN

SEQ ID NO: 5214 - protein, 6 aa, Brucella spp.
GQQTFD

SEQ ID NO: 5215 - protein, 9 aa, Brucella spp.
RKYQTDGEF

SEQ ID NO: 5216 - protein, 8 aa, Brucella spp.
ARNDRDNM

SEQ ID NO: 5217 - protein, 6 aa, Brucella spp.
TSDTGK

SEQ ID NO: 5218 - protein, 7 aa, Brucella spp.
GEARDSL

SEQ ID NO: 5219 - protein, 5 aa, Brucella spp.
DSNPG

SEQ ID NO: 5220 - protein, 14 aa, Brucella spp.
NATTPITRSTTATL

SEQ ID NO: 5221 - protein, 6 aa, Brucella spp.
GRLDEP

SEQ ID NO: 5222 - protein, 10 aa, Brucella spp.
EAAKEDTVAR

SEQ ID NO: 5223 - protein, 7 aa, Brucella spp.
DADPSAV

SEQ ID NO: 5224 - protein, 6 aa, Brucella spp.
DIAARA

SEQ ID NO: 5225 - protein, 16 aa, Brucella spp.
ARGPLTDTINNTKTFT

SEQ ID NO: 5226 - protein, 5 aa, Brucella spp.
QNAGN

SEQ ID NO: 5227 - protein, 11 aa, Brucella spp.
KMLSADDKNGL

SEQ ID NO: 5228 - protein, 8 aa, Brucella spp.
RETSNNLD

SEQ ID NO: 5229 - protein, 7 aa, Brucella spp.
RFSGQGL

SEQ ID NO: 5230 - protein, 4 aa, Brucella spp.
ERNP

SEQ ID NO: 5231 - protein, 4 aa, Brucella spp.
SDFD

SEQ ID NO: 5232 - protein, 7 aa, Brucella spp.
PKPGKLE

SEQ ID NO: 5233 - protein, 9 aa, Brucella spp.
ATKPLGNQR

SEQ ID NO: 5234 - protein, 4 aa, Brucella spp.
SPGV

SEQ ID NO: 5235 - protein, 13 aa, Brucella spp.
DDPATAAEYTARG

SEQ ID NO: 5236 - protein, 5 aa, Brucella spp.
KPVME

SEQ ID NO: 5237 - protein, 7 aa, Brucella spp.
GKKIEEA

SEQ ID NO: 5238 - protein, 7 aa, Brucella spp.
TSGAGAA

SEQ ID NO: 5239 - protein, 8 aa, Brucella spp.
AQKTDART

SEQ ID NO: 5240 - protein, 8 aa, Brucella spp.
PKPEIMPE

SEQ ID NO: 5241 - protein, 7 aa, Brucella spp.
EARAARA

SEQ ID NO: 5242 - protein, 6 aa, Brucella spp.
SDFPNQ

SEQ ID NO: 5243 - protein, 22 aa, Brucella spp.
AREEPSDVAARAYSGDTPTFGP

SEQ ID NO: 5244 - protein, 12 aa, Brucella spp.
AMETGVATRPIE

SEQ ID NO: 5245 - protein, 7 aa, Brucella spp.
ARTQGAP

SEQ ID NO: 5246 - protein, 7 aa, Brucella spp.
DGEDERV

SEQ ID NO: 5247 - protein, 4 aa, Brucella spp.
RPGT

SEQ ID NO: 5248 - protein, 8 aa, Brucella spp.
PEDDPRYR

SEQ ID NO: 5249 - protein, 10 aa, Brucella spp.
GRQGVTPEAA

SEQ ID NO: 5250 - protein, 4 aa, Brucella spp.
NSTA

SEQ ID NO: 5251 - protein, 9 aa, Brucella spp.
NAEPDANEI

SEQ ID NO: 5252 - protein, 15 aa, Brucella spp.
SNFGSKESASAEKMR

SEQ ID NO: 5253 - protein, 14 aa, Brucella spp.
KAPDLESDGEMHGD

SEQ ID NO: 5254 - protein, 4 aa, Brucella spp.
LSQT

SEQ ID NO: 5255 - protein, 6 aa, Brucella spp.
SRLKGE

SEQ ID NO: 5256 - protein, 5 aa, Brucella spp.
SVTSR

SEQ ID NO: 5257 - protein, 4 aa, Brucella spp.
NPTM

SEQ ID NO: 5258 - protein, 12 aa, Brucella spp.
AKARTARAEAAR

SEQ ID NO: 5259 - protein, 5 aa, Brucella spp.
YPPED

SEQ ID NO: 5260 - protein, 9 aa, Brucella spp.
DTADGGPGV

SEQ ID NO: 5261 - protein, 9 aa, Brucella spp.
HRDSGSHNA

SEQ ID NO: 5262 - protein, 5 aa, Brucella spp.
NYGEF

SEQ ID NO: 5263 - protein, 8 aa, Brucella spp.
EPGPMPGP

SEQ ID NO: 5264 - protein, 6 aa, Brucella spp.
TLAESG

SEQ ID NO: 5265 - protein, 7 aa, Brucella spp.
NGSPYHR

SEQ ID NO: 5266 - protein, 5 aa, Brucella spp.
VGGQD

SEQ ID NO: 5267 - protein, 21 aa, Brucella spp.
QRDGDGWRCRDGEKASLPEGL

SEQ ID NO: 5268 - protein, 4 aa, Brucella spp.
LGKD

SEQ ID NO: 5269 - protein, 11 aa, Brucella spp.
TSEESLADAAD

SEQ ID NO: 5270 - protein, 17 aa, Brucella spp.
SGTDSGVTEENLQSRAR

SEQ ID NO: 5271 - protein, 8 aa, Brucella spp.
TGNKSEMS

SEQ ID NO: 5272 - protein, 4 aa, Brucella spp.
GFNP

SEQ ID NO: 5273 - protein, 14 aa, Brucella spp.
QNLPQGALGPAGEV

SEQ ID NO: 5274 - protein, 21 aa, Brucella spp.
KAPSAELRENQTDQDSLPPYP

SEQ ID NO: 5275 - protein, 10 aa, Brucella spp.
KRRQSTPGVK

SEQ ID NO: 5276 - protein, 18 aa, Brucella spp.
KNFGRDRRYPITNRFRDR

SEQ ID NO: 5277 - protein, 8 aa, Brucella spp.
AGNEKAVQ

SEQ ID NO: 5278 - protein, 6 aa, Brucella spp.
AARALK

SEQ ID NO: 5279 - protein, 6 aa, Brucella spp.
QKDPNL

SEQ ID NO: 5280 - protein, 11 aa, Brucella spp.
RADLETESARA

SEQ ID NO: 5281 - protein, 5 aa, Brucella spp.
FTEDE

SEQ ID NO: 5282 - protein, 9 aa, Brucella spp.
TSPAGKKLL

SEQ ID NO: 5283 - protein, 4 aa, Brucella spp.
SEGP

SEQ ID NO: 5284 - protein, 14 aa, Brucella spp.
QAGATAAPQQPAKQ

SEQ ID NO: 5285 - protein, 7 aa, Brucella spp.
GTGSTAE

SEQ ID NO: 5286 - protein, 7 aa, Brucella spp.
PTSERTA

SEQ ID NO: 5287 - protein, 4 aa, Brucella spp.
EETP

SEQ ID NO: 5288 - protein, 8 aa, Brucella spp.
GADEVDGE

SEQ ID NO: 5289 - protein, 6 aa, Brucella spp.
KGGGGA

SEQ ID NO: 5290 - protein, 6 aa, Brucella spp.
GSPFLT

SEQ ID NO: 5291 - protein, 10 aa, Brucella spp.
GRIPDPKTLS

SEQ ID NO: 5292 - protein, 4 aa, Brucella spp.
TAPD

SEQ ID NO: 5293 - protein, 7 aa, Brucella spp.
KTADRGS

SEQ ID NO: 5294 - protein, 9 aa, Brucella spp.
AQQQQLDDA

SEQ ID NO: 5295 - protein, 6 aa, Brucella spp.
RKPDPR

SEQ ID NO: 5296 - protein, 8 aa, Brucella spp.
RAGGNRDR

SEQ ID NO: 5297 - protein, 13 aa, Brucella spp.
SRTDIDTAKAAGI

SEQ ID NO: 5298 - protein, 24 aa, Brucella spp.
QKPIVTAPPPAPEPDQASRGSGKH

SEQ ID NO: 5299 - protein, 4 aa, Brucella spp.
DVSI

SEQ ID NO: 5300 - protein, 9 aa, Brucella spp.
PGNNGGDGY

SEQ ID NO: 5301 - protein, 9 aa, Brucella spp.
APPRQGTDA

SEQ ID NO: 5302 - protein, 7 aa, Brucella spp.
AVEGAQA

SEQ ID NO: 5303 - protein, 4 aa, Brucella spp.
ASGL

SEQ ID NO: 5304 - protein, 9 aa, Brucella spp.
PSGISGATG

SEQ ID NO: 5305 - protein, 7 aa, Brucella spp.
LPSPAVD

SEQ ID NO: 5306 - protein, 6 aa, Brucella spp.
HKYSRG

SEQ ID NO: 5307 - protein, 7 aa, Brucella spp.
HSTGAAR

SEQ ID NO: 5308 - protein, 8 aa, Brucella spp.
AARSGAGA

SEQ ID NO: 5309 - protein, 6 aa, Brucella spp.
SPPDAL

SEQ ID NO: 5310 - protein, 8 aa, Brucella spp.
TRSQQDAA

SEQ ID NO: 5311 - protein, 9 aa, Brucella spp.
GPGYGNPAF

SEQ ID NO: 5312 - protein, 9 aa, Brucella spp.
AASGKAGQF

SEQ ID NO: 5313 - protein, 9 aa, Brucella spp.
AFENKPDEL

SEQ ID NO: 5314 - protein, 6 aa, Brucella spp.
HRSSAT

SEQ ID NO: 5315 - protein, 16 aa, Brucella spp.
AEDNTSKIDKARKAAM

SEQ ID NO: 5316 - protein, 8 aa, Brucella spp.
DTVIAEPG

SEQ ID NO: 5317 - protein, 6 aa, Brucella spp.
SNGTPF

SEQ ID NO: 5318 - protein, 7 aa, Brucella spp.
TAGSGDV

SEQ ID NO: 5319 - protein, 5 aa, Brucella spp.
TDPKG

SEQ ID NO: 5320 - protein, 5 aa, Brucella spp.
DPETA

SEQ ID NO: 5321 - protein, 20 aa, Brucella spp.
LSGESYSRDPRTTAKKAEAY

SEQ ID NO: 5322 - protein, 6 aa, Brucella spp.
ADPFNT

SEQ ID NO: 5323 - protein, 24 aa, Brucella spp.
SAELPSNDDTDYETGNLGHRPRVK

SEQ ID NO: 5324 - protein, 5 aa, Brucella spp.
QHELG

SEQ ID NO: 5325 - protein, 7 aa, Brucella spp.
AYGKTAT

SEQ ID NO: 5326 - protein, 7 aa, Brucella spp.
FGDNGSG

SEQ ID NO: 5327 - protein, 13 aa, Brucella spp.
GKPTFAGNEYAGL

SEQ ID NO: 5328 - protein, 10 aa, Brucella spp.
AFTNPSTNSY

SEQ ID NO: 5329 - protein, 7 aa, Brucella spp.
ARNRSAS

SEQ ID NO: 5330 - protein, 9 aa, Brucella spp.
FGSSPKSKR

SEQ ID NO: 5331 - protein, 7 aa, Brucella spp.
PDPSANP

SEQ ID NO: 5332 - protein, 7 aa, Brucella spp.
IHPGQAM

SEQ ID NO: 5333 - protein, 6 aa, Brucella spp.
DLPPKE

SEQ ID NO: 5334 - protein, 4 aa, Brucella spp.
DKDR

SEQ ID NO: 5335 - protein, 4 aa, Brucella spp.
RSAL

SEQ ID NO: 5336 - protein, 6 aa, Brucella spp.
DTLKPG

SEQ ID NO: 5337 - protein, 7 aa, Brucella spp.
SRPGPYA

SEQ ID NO: 5338 - protein, 6 aa, Brucella spp.
CTAPEK

SEQ ID NO: 5339 - protein, 4 aa, Brucella spp.
PASK

SEQ ID NO: 5340 - protein, 6 aa, Brucella spp.
DAGEAG

SEQ ID NO: 5341 - protein, 16 aa, Brucella spp.
RVDGGRAKADTRIQAG

SEQ ID NO: 5342 - protein, 10 aa, Brucella spp.
DEKAAGPMTA

SEQ ID NO: 5343 - protein, 10 aa, Brucella spp.
TIRNQQDGDV

SEQ ID NO: 5344 - protein, 12 aa, Brucella spp.
GLAVQGGSGVTR

SEQ ID NO: 5345 - protein, 9 aa, Brucella spp.
RSKKGEKPR

SEQ ID NO: 5346 - protein, 5 aa, Brucella spp.
RDTSG

SEQ ID NO: 5347 - protein, 8 aa, Brucella spp.
TRGAAQAL

SEQ ID NO: 5348 - protein, 9 aa, Brucella spp.
FRERDTKKT

SEQ ID NO: 5349 - protein, 9 aa, Brucella spp.
VPRKREDKI

SEQ ID NO: 5350 - protein, 8 aa, Brucella spp.
EQTPDGDK

SEQ ID NO: 5351 - protein, 9 aa, Brucella spp.
HGEPDSDHA

SEQ ID NO: 5352 - protein, 5 aa, Brucella spp.
YTGRT

SEQ ID NO: 5353 - protein, 8 aa, Brucella spp.
IPNPSGGI

SEQ ID NO: 5354 - protein, 6 aa, Brucella spp.
ISDKGD

SEQ ID NO: 5355 - protein, 7 aa, Brucella spp.
KRGTSNA

SEQ ID NO: 5356 - protein, 10 aa, Brucella spp.
KTKDGQAAVE

SEQ ID NO: 5357 - protein, 9 aa, Brucella spp.
IASETQALR

SEQ ID NO: 5358 - protein, 4 aa, Brucella spp.
LENA

SEQ ID NO: 5359 - protein, 11 aa, Brucella spp.
ATADRQEPENV

SEQ ID NO: 5360 - protein, 8 aa, Brucella spp.
FPNSGQGV

SEQ ID NO: 5361 - protein, 6 aa, Brucella spp.
VKPGQT

SEQ ID NO: 5362 - protein, 9 aa, Brucella spp.
GPTGAGKTT

SEQ ID NO: 5363 - protein, 8 aa, Brucella spp.
TDTRTVSR

SEQ ID NO: 5364 - protein, 9 aa, Brucella spp.
RANATHEEV

SEQ ID NO: 5365 - protein, 6 aa, Brucella spp.
AKAAAA

SEQ ID NO: 5366 - protein, 6 aa, Brucella spp.
SEGYDT

SEQ ID NO: 5367 - protein, 14 aa, Brucella spp.
GERGSQLSGGERQR

SEQ ID NO: 5368 - protein, 15 aa, Brucella spp.
TSALDVETEEKLKQA

SEQ ID NO: 5369 - protein, 4 aa, Brucella spp.
LSHN

SEQ ID NO: 5370 - protein, 4 aa, Brucella spp.
ESGS

SEQ ID NO: 5371 - protein, 8 aa, Brucella spp.
ELAERGGR

SEQ ID NO: 5372 - protein, 12 aa, Brucella spp.
LEDKQPKQPVVE

SEQ ID NO: 5373 - protein, 10 aa, Brucella spp.
GSSPGVPRIN

SEQ ID NO: 5374 - protein, 13 aa, Brucella spp.
KCDPKNPKNRRRR

SEQ ID NO: 5375 - protein, 7 aa, Brucella spp.
DAEGNNT

SEQ ID NO: 5376 - protein, 7 aa, Brucella spp.
VGSSYPP

SEQ ID NO: 5377 - protein, 6 aa, Brucella spp.
APETPF

SEQ ID NO: 5378 - protein, 5 aa, Brucella spp.
EGAGG

SEQ ID NO: 5379 - protein, 5 aa, Brucella spp.
AFPEQ

SEQ ID NO: 5380 - protein, 4 aa, Brucella spp.
RPHP

SEQ ID NO: 5381 - protein, 4 aa, Brucella spp.
SPKR

SEQ ID NO: 5382 - protein, 14 aa, Brucella spp.
VEPGYDGLRFEVAV

SEQ ID NO: 5383 - protein, 5 aa, Brucella spp.
EPERD

SEQ ID NO: 5384 - protein, 10 aa, Brucella spp.
GTHPNNAHEE

SEQ ID NO: 5385 - protein, 8 aa, Brucella spp.
APKEAQQQ

SEQ ID NO: 5386 - protein, 5 aa, Brucella spp.
ARRTQ

SEQ ID NO: 5387 - protein, 8 aa, Brucella spp.
EKETEKGA

SEQ ID NO: 5388 - protein, 6 aa, Brucella spp.
RALAEK

SEQ ID NO: 5389 - protein, 4 aa, Brucella spp.
ADIR

SEQ ID NO: 5390 - protein, 11 aa, Brucella spp.
PHRGKRNEPSF

SEQ ID NO: 5391 - protein, 6 aa, Brucella spp.
GVSPEE

SEQ ID NO: 5392 - protein, 8 aa, Brucella spp.
YPNGKPHI

SEQ ID NO: 5393 - protein, 4 aa, Brucella spp.
TDEH

SEQ ID NO: 5394 - protein, 19 aa, Brucella spp.
ARKEGITPRELADRNTSAF

SEQ ID NO: 5395 - protein, 17 aa, Brucella spp.
NSSNDDYIRTSEERHYK

SEQ ID NO: 5396 - protein, 4 aa, Brucella spp.
YKGG

SEQ ID NO: 5397 - protein, 13 aa, Brucella spp.
AYYGEEETEVRAD

SEQ ID NO: 5398 - protein, 10 aa, Brucella spp.
GVRYGPQGTP

SEQ ID NO: 5399 - protein, 5 aa, Brucella spp.
VPGDE

SEQ ID NO: 5400 - protein, 7 aa, Brucella spp.
YPDTTDE

SEQ ID NO: 5401 - protein, 7 aa, Brucella spp.
EKMSKSV

SEQ ID NO: 5402 - protein, 8 aa, Brucella spp.
GQDGSYSH

SEQ ID NO: 5403 - protein, 9 aa, Brucella spp.
RTNADLAND

SEQ ID NO: 5404 - protein, 4 aa, Brucella spp.
NLAQ

SEQ ID NO: 5405 - protein, 14 aa, Brucella spp.
EGKVPQPGAFSEAD

SEQ ID NO: 5406 - protein, 12 aa, Brucella spp.
AALETARKAMDD

SEQ ID NO: 5407 - protein, 7 aa, Brucella spp.
KTDPARM

SEQ ID NO: 5408 - protein, 7 aa, Brucella spp.
APADKRQ

SEQ ID NO: 5409 - protein, 13 aa, Brucella spp.
PLAGGTDLPAPQP

SEQ ID NO: 5410 - protein, 11 aa, Brucella spp.
EGVPGPSASAY

SEQ ID NO: 5411 - protein, 6 aa, Brucella spp.
PQGIGK

SEQ ID NO: 5412 - protein, 8 aa, Brucella spp.
DRNEAPET

SEQ ID NO: 5413 - protein, 9 aa, Brucella spp.
FDQKTGKFR

SEQ ID NO: 5414 - protein, 9 aa, Brucella spp.
ADDMNRNAA

SEQ ID NO: 5415 - protein, 6 aa, Brucella spp.
LEEPPA

SEQ ID NO: 5416 - protein, 7 aa, Brucella spp.
LDGETLG

SEQ ID NO: 5417 - protein, 13 aa, Brucella spp.
SHAGSKAGISAGD

SEQ ID NO: 5418 - protein, 7 aa, Brucella spp.
RSEGSVR

SEQ ID NO: 5419 - protein, 4 aa, Brucella spp.
REAE

SEQ ID NO: 5420 - protein, 13 aa, Brucella spp.
ARRYADSGQLREA

SEQ ID NO: 5421 - protein, 6 aa, Brucella spp.
EAETYN

SEQ ID NO: 5422 - protein, 6 aa, Brucella spp.
KRGSAA

SEQ ID NO: 5423 - protein, 17 aa, Brucella spp.
ASTPQTKSKHKRSKGYF

SEQ ID NO: 5424 - protein, 9 aa, Brucella spp.
YGVKASPRV

SEQ ID NO: 5425 - protein, 19 aa, Brucella spp.
GQPMPRGGGRDQTGKPYQV

SEQ ID NO: 5426 - protein, 10 aa, Brucella spp.
PKEDKNYTAV

SEQ ID NO: 5427 - protein, 4 aa, Brucella spp.
ANGE

SEQ ID NO: 5428 - protein, 4 aa, Brucella spp.
PTMP

SEQ ID NO: 5429 - protein, 6 aa, Brucella spp.
NLDTGS

SEQ ID NO: 5430 - protein, 6 aa, Brucella spp.
DRGPYE

SEQ ID NO: 5431 - protein, 4 aa, Brucella spp.
HGTA

SEQ ID NO: 5432 - protein, 7 aa, Brucella spp.
APLEGND

SEQ ID NO: 5433 - protein, 14 aa, Brucella spp.
YRPGGGDTIGQPAT

SEQ ID NO: 5434 - protein, 11 aa, Brucella spp.
GPTPTSPKSHI

SEQ ID NO: 5435 - protein, 8 aa, Brucella spp.
APIPQESP

SEQ ID NO: 5436 - protein, 13 aa, Brucella spp.
NPAYGDPSGQAPV

SEQ ID NO: 5437 - protein, 9 aa, Brucella spp.
TIRPGSSFG

SEQ ID NO: 5438 - protein, 5 aa, Brucella spp.
YASDR

SEQ ID NO: 5439 - protein, 12 aa, Brucella spp.
ATAAYREEKTYG

SEQ ID NO: 5440 - protein, 11 aa, Brucella spp.
KRRNAEDEGEY

SEQ ID NO: 5441 - protein, 14 aa, Brucella spp.
KKLESALPRSARVT

SEQ ID NO: 5442 - protein, 10 aa, Brucella spp.
REKIPTENGE

SEQ ID NO: 5443 - protein, 8 aa, Brucella spp.
AEKGGNDA

SEQ ID NO: 5444 - protein, 12 aa, Brucella spp.
AGATDAFVVRRD

SEQ ID NO: 5445 - protein, 17 aa, Brucella spp.
EGGYVDHPKDPGGATNM

SEQ ID NO: 5446 - protein, 21 aa, Brucella spp.
EGRKVSKAEVKALTKTKATDI

SEQ ID NO: 5447 - protein, 9 aa, Brucella spp.
GDDLPAGVD

SEQ ID NO: 5448 - protein, 5 aa, Brucella spp.
SGPAR

SEQ ID NO: 5449 - protein, 4 aa, Brucella spp.
QDGV

SEQ ID NO: 5450 - protein, 25 aa, Brucella spp.
RDSAPAPSPVPQVPTGKAVQSDTSL

SEQ ID NO: 5451 - protein, 7 aa, Brucella spp.
NPEAWGP

SEQ ID NO: 5452 - protein, 8 aa, Brucella spp.
MADGSGPM

SEQ ID NO: 5453 - protein, 8 aa, Brucella spp.
PGQLDPYQ

SEQ ID NO: 5454 - protein, 7 aa, Brucella spp.
LNQGSGV

SEQ ID NO: 5455 - protein, 7 aa, Brucella spp.
TNGQPPL

SEQ ID NO: 5456 - protein, 9 aa, Brucella spp.
RKRRTSKRK

SEQ ID NO: 5457 - protein, 7 aa, Brucella spp.
SDETIDR

SEQ ID NO: 5458 - protein, 4 aa, Brucella spp.
NAQK

SEQ ID NO: 5459 - protein, 5 aa, Brucella spp.
NAKQK

SEQ ID NO: 5460 - protein, 4 aa, Brucella spp.
ASGA

SEQ ID NO: 5461 - protein, 7 aa, Brucella spp.
NDGRMPE

SEQ ID NO: 5462 - protein, 4 aa, Brucella spp.
RPHK

SEQ ID NO: 5463 - protein, 5 aa, Brucella spp.
EHQRP

SEQ ID NO: 5464 - protein, 6 aa, Brucella spp.
VTPTNF

SEQ ID NO: 5465 - protein, 6 aa, Brucella spp.
SVGTPS

SEQ ID NO: 5466 - protein, 6 aa, Brucella spp.
YRGGSL

SEQ ID NO: 5467 - protein, 7 aa, Brucella spp.
SQNYGEQ

SEQ ID NO: 5468 - protein, 5 aa, Brucella spp.
TYDIG

SEQ ID NO: 5469 - protein, 8 aa, Brucella spp.
EVPPEDVN

SEQ ID NO: 5470 - protein, 7 aa, Brucella spp.
GQNNCAD

SEQ ID NO: 5471 - protein, 9 aa, Brucella spp.
PRPGEGDAE

SEQ ID NO: 5472 - protein, 7 aa, Brucella spp.
ATTPHTR

SEQ ID NO: 5473 - protein, 5 aa, Brucella spp.
GLPAS

SEQ ID NO: 5474 - protein, 9 aa, Brucella spp.
NPNAHKNHA

SEQ ID NO: 5475 - protein, 4 aa, Brucella spp.
GKIK

SEQ ID NO: 5476 - protein, 6 aa, Brucella spp.
YENKAY

SEQ ID NO: 5477 - protein, 5 aa, Brucella spp.
ADKEY

SEQ ID NO: 5478 - protein, 6 aa, Brucella spp.
ADNGTF

SEQ ID NO: 5479 - protein, 4 aa, Brucella spp.
NDYP

SEQ ID NO: 5480 - protein, 5 aa, Brucella spp.
MEETP

SEQ ID NO: 5481 - protein, 5 aa, Brucella spp.
NQPVP

SEQ ID NO: 5482 - protein, 15 aa, Brucella spp.
EDAAARAEAAASGVN

SEQ ID NO: 5483 - protein, 9 aa, Brucella spp.
ISAADAGKS

SEQ ID NO: 5484 - protein, 7 aa, Brucella spp.
QDGTGYD

SEQ ID NO: 5485 - protein, 15 aa, Brucella spp.
TETQAKAPGTPENDG

SEQ ID NO: 5486 - protein, 6 aa, Brucella spp.
QQGQAR

SEQ ID NO: 5487 - protein, 10 aa, Brucella spp.
DNGSNSAISA

SEQ ID NO: 5488 - protein, 8 aa, Brucella spp.
SAVNSGET

SEQ ID NO: 5489 - protein, 7 aa, Brucella spp.
PKTDDSY

SEQ ID NO: 5490 - protein, 12 aa, Brucella spp.
LRGASGGSKIKR

SEQ ID NO: 5491 - protein, 8 aa, Brucella spp.
DGSEMTGQ

SEQ ID NO: 5492 - protein, 5 aa, Brucella spp.
NDASR

SEQ ID NO: 5493 - protein, 4 aa, Brucella spp.
NSGG

SEQ ID NO: 5494 - protein, 12 aa, Brucella spp.
DDNNVKGAAATP

SEQ ID NO: 5495 - protein, 6 aa, Brucella spp.
GPQYGG

SEQ ID NO: 5496 - protein, 8 aa, Brucella spp.
EATGLDGY

SEQ ID NO: 5497 - protein, 5 aa, Brucella spp.
PDAEQ

SEQ ID NO: 5498 - protein, 8 aa, Brucella spp.
DNNKGDGV

SEQ ID NO: 5499 - protein, 14 aa, Brucella spp.
DGNDLNSSIDGGTG

SEQ ID NO: 5500 - protein, 19 aa, Brucella spp.
RSGGRRNMAPGNLNTVSQG

SEQ ID NO: 5501 - protein, 15 aa, Brucella spp.
TDKQLAKAKPFKESF

SEQ ID NO: 5502 - protein, 17 aa, Brucella spp.
KAIRGRPRIDNPKTPVT

SEQ ID NO: 5503 - protein, 9 aa, Brucella spp.
ATGKGWQGR

SEQ ID NO: 5504 - protein, 12 aa, Brucella spp.
GISTSQYDAAER

SEQ ID NO: 5505 - protein, 9 aa, Brucella spp.
KRKAECSAG

SEQ ID NO: 5506 - protein, 10 aa, Brucella spp.
IGASDPDEYE

SEQ ID NO: 5507 - protein, 23 aa, Brucella spp.
AKQAYADARGAIDEAQAETRNSN

SEQ ID NO: 5508 - protein, 20 aa, Brucella spp.
PSAEVQGHSPEQRVTVGGKR

SEQ ID NO: 5509 - protein, 6 aa, Brucella spp.
TGGEPL

SEQ ID NO: 5510 - protein, 4 aa, Brucella spp.
KSGA

SEQ ID NO: 5511 - protein, 6 aa, Brucella spp.
TTNGSQ

SEQ ID NO: 5512 - protein, 5 aa, Brucella spp.
LNPEK

SEQ ID NO: 5513 - protein, 6 aa, Brucella spp.
AAQKAG

SEQ ID NO: 5514 - protein, 8 aa, Brucella spp.
YRTGGPAR

SEQ ID NO: 5515 - protein, 6 aa, Brucella spp.
SETGGR

SEQ ID NO: 5516 - protein, 7 aa, Brucella spp.
NDDADLR

SEQ ID NO: 5517 - protein, 11 aa, Brucella spp.
LRESESDEHLS

SEQ ID NO: 5518 - protein, 9 aa, Brucella spp.
AISRKPKGH

SEQ ID NO: 5519 - protein, 15 aa, Brucella spp.
HNRPSVARHMSLTGG

SEQ ID NO: 5520 - protein, 4 aa, Brucella spp.
GDLS

SEQ ID NO: 5521 - protein, 4 aa, Brucella spp.
ADTP

SEQ ID NO: 5522 - protein, 7 aa, Brucella spp.
KQAETGA

SEQ ID NO: 5523 - protein, 4 aa, Brucella spp.
RLAE

SEQ ID NO: 5524 - protein, 15 aa, Brucella spp.
TAGALSYRARPPHFN

SEQ ID NO: 5525 - protein, 16 aa, Brucella spp.
HEGTDSWRHRKAGAAE

SEQ ID NO: 5526 - protein, 8 aa, Brucella spp.
DDGEPSLS

SEQ ID NO: 5527 - protein, 6 aa, Brucella spp.
KREPHK

SEQ ID NO: 5528 - protein, 18 aa, Brucella spp.
RRNGGHEGPHLSKTDPGI

SEQ ID NO: 5529 - protein, 7 aa, Brucella spp.
MPQNDES

SEQ ID NO: 5530 - protein, 5 aa, Brucella spp.
EPKIA

SEQ ID NO: 5531 - protein, 14 aa, Brucella spp.
AFKAGAGAKPGADP

SEQ ID NO: 5532 - protein, 6 aa, Brucella spp.
PPNVTG

SEQ ID NO: 5533 - protein, 10 aa, Brucella spp.
AERKEPNRHA

SEQ ID NO: 5534 - protein, 6 aa, Brucella spp.
ESGGMI

SEQ ID NO: 5535 - protein, 5 aa, Brucella spp.
VESRE

SEQ ID NO: 5536 - protein, 6 aa, Brucella spp.
FDPENP

SEQ ID NO: 5537 - protein, 6 aa, Brucella spp.
TRPETM

SEQ ID NO: 5538 - protein, 9 aa, Brucella spp.
VAVNPKDER

SEQ ID NO: 5539 - protein, 13 aa, Brucella spp.
YADPEAGSGTVKI

SEQ ID NO: 5540 - protein, 4 aa, Brucella spp.
KRNN

SEQ ID NO: 5541 - protein, 12 aa, Brucella spp.
AVPHGDRGGVPI

SEQ ID NO: 5542 - protein, 5 aa, Brucella spp.
LAKPA

SEQ ID NO: 5543 - protein, 6 aa, Brucella spp.
RDGRTQ

SEQ ID NO: 5544 - protein, 14 aa, Brucella spp.
SEAEAKAAARAHYG

SEQ ID NO: 5545 - protein, 4 aa, Brucella spp.
ERDT

SEQ ID NO: 5546 - protein, 8 aa, Brucella spp.
PDKTPELA

SEQ ID NO: 5547 - protein, 14 aa, Brucella spp.
KHGAKMSKSKGNVI

SEQ ID NO: 5548 - protein, 10 aa, Brucella spp.
GRDVKLDPAR

SEQ ID NO: 5549 - protein, 8 aa, Brucella spp.
PDFRPENA

SEQ ID NO: 5550 - protein, 7 aa, Brucella spp.
ATRAVTE

SEQ ID NO: 5551 - protein, 12 aa, Brucella spp.
DEAAKAEAQATA

SEQ ID NO: 5552 - protein, 10 aa, Brucella spp.
TASEGKKRDT

SEQ ID NO: 5553 - protein, 8 aa, Brucella spp.
EDEDAAAD

SEQ ID NO: 5554 - protein, 8 aa, Brucella spp.
QQAPKGAA

SEQ ID NO: 5555 - protein, 10 aa, Brucella spp.
ARLAKEAGKI

SEQ ID NO: 5556 - protein, 15 aa, Brucella spp.
AQRVATAESRIRDAS

SEQ ID NO: 5557 - protein, 6 aa, Brucella spp.
ALSETL

SEQ ID NO: 5558 - protein, 15 aa, Brucella spp.
KNNAPLNSSRAGVRI

SEQ ID NO: 5559 - protein, 9 aa, Brucella spp.
SAYRPQITG

SEQ ID NO: 5560 - protein, 20 aa, Brucella spp.
SYNISRGKTPATDYRTTGTV

SEQ ID NO: 5561 - protein, 9 aa, Brucella spp.
TRNNVAAAE

SEQ ID NO: 5562 - protein, 11 aa, Brucella spp.
ENLRNDEQNTL

SEQ ID NO: 5563 - protein, 19 aa, Brucella spp.
VGEGTRTDVAQAEASRSTA

SEQ ID NO: 5564 - protein, 11 aa, Brucella spp.
ARADVKTAEAT

SEQ ID NO: 5565 - protein, 10 aa, Brucella spp.
PDKLTPASAA

SEQ ID NO: 5566 - protein, 13 aa, Brucella spp.
RHLPQSPSQAYAS

SEQ ID NO: 5567 - protein, 4 aa, Brucella spp.
SHPG

SEQ ID NO: 5568 - protein, 9 aa, Brucella spp.
YNVKAKEGA

SEQ ID NO: 5569 - protein, 9 aa, Brucella spp.
ASASQLDTI

SEQ ID NO: 5570 - protein, 14 aa, Brucella spp.
AGTDMGDGNTASIG

SEQ ID NO: 5571 - protein, 19 aa, Brucella spp.
TGGRTSAQIRQSKEQLGQA

SEQ ID NO: 5572 - protein, 12 aa, Brucella spp.
RASVAANRDGIA

SEQ ID NO: 5573 - protein, 8 aa, Brucella spp.
RKVGQRTT

SEQ ID NO: 5574 - protein, 6 aa, Brucella spp.
TGRMTA

SEQ ID NO: 5575 - protein, 8 aa, Brucella spp.
YKPEEHYK

SEQ ID NO: 5576 - protein, 4 aa, Brucella spp.
AAAN

SEQ ID NO: 5577 - protein, 6 aa, Brucella spp.
KGGCAG

SEQ ID NO: 5578 - protein, 12 aa, Brucella spp.
EAKAGDDLIEKD

SEQ ID NO: 5579 - protein, 13 aa, Brucella spp.
NPNQTSACGCGES

SEQ ID NO: 5580 - protein, 16 aa, Brucella spp.
LKPASPESLRQMQGTA

SEQ ID NO: 5581 - protein, 11 aa, Brucella spp.
AGYTAPTPIQA

SEQ ID NO: 5582 - protein, 7 aa, Brucella spp.
AIPPALE

SEQ ID NO: 5583 - protein, 9 aa, Brucella spp.
AQTGTGKTA

SEQ ID NO: 5584 - protein, 7 aa, Brucella spp.
GRARARM

SEQ ID NO: 5585 - protein, 10 aa, Brucella spp.
EEQERKLERG

SEQ ID NO: 5586 - protein, 4 aa, Brucella spp.
PPEI

SEQ ID NO: 5587 - protein, 10 aa, Brucella spp.
KASSTAKTVT

SEQ ID NO: 5588 - protein, 9 aa, Brucella spp.
KSGKKDWDK

SEQ ID NO: 5589 - protein, 6 aa, Brucella spp.
SEGDSL

SEQ ID NO: 5590 - protein, 5 aa, Brucella spp.
GDMDQ

SEQ ID NO: 5591 - protein, 11 aa, Brucella spp.
RTGRAGRSGKA

SEQ ID NO: 5592 - protein, 6 aa, Brucella spp.
SSDTKY

SEQ ID NO: 5593 - protein, 44 aa, Brucella spp.
SEEADEQPRKGRNARGKGKEKPKEKASKPVAAKTVDPAGQPQPV

SEQ ID NO: 5594 - protein, 38 aa, Brucella spp.
HRREAIRSSNEERRGKPQTEQHKRRRDRDDDGPAPVGF

SEQ ID NO: 5595 - protein, 11 aa, Brucella spp.
SGTKESLSAQK

SEQ ID NO: 5596 - protein, 4 aa, Brucella spp.
GDGT

SEQ ID NO: 5597 - protein, 8 aa, Brucella spp.
TDDAPPVE

SEQ ID NO: 5598 - protein, 10 aa, Brucella spp.
TPAGSTAYNL

SEQ ID NO: 5599 - protein, 19 aa, Brucella spp.
TEKRPVNAVADNNEVKSVT

SEQ ID NO: 5600 - protein, 8 aa, Brucella spp.
VREAPNSQ

SEQ ID NO: 5601 - protein, 10 aa, Brucella spp.
GASAQKPQSV

SEQ ID NO: 5602 - protein, 12 aa, Brucella spp.
ATDAYEKSRETV

SEQ ID NO: 5603 - protein, 5 aa, Brucella spp.
ATEAI

SEQ ID NO: 5604 - protein, 6 aa, Brucella spp.
RLSERT

SEQ ID NO: 5605 - protein, 5 aa, Brucella spp.
GSQGA

SEQ ID NO: 5606 - protein, 5 aa, Brucella spp.
YGPSG

SEQ ID NO: 5607 - protein, 6 aa, Brucella spp.
PFQGGG

SEQ ID NO: 5608 - protein, 6 aa, Brucella spp.
EENVTY

SEQ ID NO: 5609 - protein, 6 aa, Brucella spp.
AGTPPI

SEQ ID NO: 5610 - protein, 7 aa, Brucella spp.
NAPDKGA

SEQ ID NO: 5611 - protein, 5 aa, Brucella spp.
RTPAE

SEQ ID NO: 5612 - protein, 7 aa, Brucella spp.
GDLPGNG

SEQ ID NO: 5613 - protein, 6 aa, Brucella spp.
GLPSRR

SEQ ID NO: 5614 - protein, 10 aa, Brucella spp.
FDTSAGTQAL

SEQ ID NO: 5615 - protein, 7 aa, Brucella spp.
AAKAPKG

SEQ ID NO: 5616 - protein, 7 aa, Brucella spp.
SRGFDDT

SEQ ID NO: 5617 - protein, 6 aa, Brucella spp.
DTELEE

SEQ ID NO: 5618 - protein, 8 aa, Brucella spp.
QNAGQGHT

SEQ ID NO: 5619 - protein, 12 aa, Brucella spp.
RQNGGEGDAFST

SEQ ID NO: 5620 - protein, 4 aa, Brucella spp.
QATQ

SEQ ID NO: 5621 - protein, 4 aa, Brucella spp.
GKGS

SEQ ID NO: 5622 - protein, 8 aa, Brucella spp.
VEGEDSDF

SEQ ID NO: 5623 - protein, 7 aa, Brucella spp.
DDSHTDV

SEQ ID NO: 5624 - protein, 6 aa, Brucella spp.
NTRSTE

SEQ ID NO: 5625 - protein, 5 aa, Brucella spp.
DRARG

SEQ ID NO: 5626 - protein, 7 aa, Brucella spp.
AQKTDAR

SEQ ID NO: 5627 - protein, 8 aa, Brucella spp.
EGEFDAKP

SEQ ID NO: 5628 - protein, 7 aa, Brucella spp.
IPENEAR

SEQ ID NO: 5629 - protein, 6 aa, Brucella spp.
ADTDTE

SEQ ID NO: 5630 - protein, 10 aa, Brucella spp.
GPNGSGKSTL

SEQ ID NO: 5631 - protein, 7 aa, Brucella spp.
DDYEVTE

SEQ ID NO: 5632 - protein, 7 aa, Brucella spp.
PAERAAK

SEQ ID NO: 5633 - protein, 12 aa, Brucella spp.
NSQRKARGEPEL

SEQ ID NO: 5634 - protein, 6 aa, Brucella spp.
DAAGGL

SEQ ID NO: 5635 - protein, 10 aa, Brucella spp.
FSGGEKKRAE

SEQ ID NO: 5636 - protein, 7 aa, Brucella spp.
ETDSGLD

SEQ ID NO: 5637 - protein, 6 aa, Brucella spp.
ALRSPD

SEQ ID NO: 5638 - protein, 7 aa, Brucella spp.
IKSGDKS

SEQ ID NO: 5639 - protein, 5 aa, Brucella spp.
APLLD

SEQ ID NO: 5640 - protein, 15 aa, Brucella spp.
ITGNPSSVHREGRAA

SEQ ID NO: 5641 - protein, 6 aa, Brucella spp.
SARRSV

SEQ ID NO: 5642 - protein, 8 aa, Brucella spp.
GATEAAST

SEQ ID NO: 5643 - protein, 6 aa, Brucella spp.
QFSPDD

SEQ ID NO: 5644 - protein, 7 aa, Brucella spp.
HDRSKGL

SEQ ID NO: 5645 - protein, 7 aa, Brucella spp.
ANNETGV

SEQ ID NO: 5646 - protein, 8 aa, Brucella spp.
KIGGPKGV

SEQ ID NO: 5647 - protein, 15 aa, Brucella spp.
RGGGQEKGHRAGTEA

SEQ ID NO: 5648 - protein, 11 aa, Brucella spp.
VAKARIDGEGW

SEQ ID NO: 5649 - protein, 5 aa, Brucella spp.
PRLPN

SEQ ID NO: 5650 - protein, 7 aa, Brucella spp.
GQKAETV

SEQ ID NO: 5651 - protein, 13 aa, Brucella spp.
AGSACSSGKVGPS

SEQ ID NO: 5652 - protein, 9 aa, Brucella spp.
GQEDGPGAI

SEQ ID NO: 5653 - protein, 8 aa, Brucella spp.
TDAGEETV

SEQ ID NO: 5654 - protein, 15 aa, Brucella spp.
RLEGRYQPSKEKNAP

SEQ ID NO: 5655 - protein, 4 aa, Brucella spp.
FGGT

SEQ ID NO: 5656 - protein, 19 aa, Brucella spp.
GRSQGEFDHGAGELSDAAS

SEQ ID NO: 5657 - protein, 7 aa, Brucella spp.
APQPNTY

SEQ ID NO: 5658 - protein, 10 aa, Brucella spp.
QDKVAPPKDV

SEQ ID NO: 5659 - protein, 7 aa, Brucella spp.
KTQKGIT

SEQ ID NO: 5660 - protein, 4 aa, Brucella spp.
TSMD

SEQ ID NO: 5661 - protein, 4 aa, Brucella spp.
DGEN

SEQ ID NO: 5662 - protein, 8 aa, Brucella spp.
ASASMDYS

SEQ ID NO: 5663 - protein, 9 aa, Brucella spp.
IKDRAERPG

SEQ ID NO: 5664 - protein, 4 aa, Brucella spp.
SNES

SEQ ID NO: 5665 - protein, 10 aa, Brucella spp.
MRHGGQGAPL

SEQ ID NO: 5666 - protein, 7 aa, Brucella spp.
YDSGPGN

SEQ ID NO: 5667 - protein, 20 aa, Brucella spp.
RFDPGGATAMSGSVDRNTAH

SEQ ID NO: 5668 - protein, 6 aa, Brucella spp.
HRRSLD

SEQ ID NO: 5669 - protein, 5 aa, Brucella spp.
IPAKG

SEQ ID NO: 5670 - protein, 7 aa, Brucella spp.
LNLADGA

SEQ ID NO: 5671 - protein, 6 aa, Brucella spp.
HLPARP

SEQ ID NO: 5672 - protein, 9 aa, Brucella spp.
SGGGRKNGA

SEQ ID NO: 5673 - protein, 5 aa, Brucella spp.
AERQG

SEQ ID NO: 5674 - protein, 10 aa, Brucella spp.
DNAGFDGDAM

SEQ ID NO: 5675 - protein, 19 aa, Brucella spp.
YPSTTGCDKPVSGGVPVRP

SEQ ID NO: 5676 - protein, 16 aa, Brucella spp.
ESGEGIVSGSVRSARS

SEQ ID NO: 5677 - protein, 7 aa, Brucella spp.
RDEAQKS

SEQ ID NO: 5678 - protein, 18 aa, Brucella spp.
GASASIGSAALSRDRNGH

SEQ ID NO: 5679 - protein, 7 aa, Brucella spp.
DPKQGVA

SEQ ID NO: 5680 - protein, 7 aa, Brucella spp.
PEARGGG

SEQ ID NO: 5681 - protein, 5 aa, Brucella spp.
YDEKG

SEQ ID NO: 5682 - protein, 6 aa, Brucella spp.
VGEEEQ

SEQ ID NO: 5683 - protein, 7 aa, Brucella spp.
LTEDRGK

SEQ ID NO: 5684 - protein, 11 aa, Brucella spp.
DIERRASDKAL

SEQ ID NO: 5685 - protein, 6 aa, Brucella spp.
SPPQVA

SEQ ID NO: 5686 - protein, 5 aa, Brucella spp.
GNRVN

SEQ ID NO: 5687 - protein, 11 aa, Brucella spp.
AADGDKPERLA

SEQ ID NO: 5688 - protein, 4 aa, Brucella spp.
NVRG

SEQ ID NO: 5689 - protein, 17 aa, Brucella spp.
AFGPEQEAESNTDGPSY

SEQ ID NO: 5690 - protein, 15 aa, Brucella spp.
SATSMPPESSDPPLS

SEQ ID NO: 5691 - protein, 10 aa, Brucella spp.
QTEGGQLYGQ

SEQ ID NO: 5692 - protein, 7 aa, Brucella spp.
GFGDGSP

SEQ ID NO: 5693 - protein, 16 aa, Brucella spp.
GRFNGPGLPPPLTEEE

SEQ ID NO: 5694 - protein, 10 aa, Brucella spp.
VRDADGTVSV

SEQ ID NO: 5695 - protein, 15 aa, Brucella spp.
TAYTPNNRKATVSNG

SEQ ID NO: 5696 - protein, 5 aa, Brucella spp.
GNKPI

SEQ ID NO: 5697 - protein, 5 aa, Brucella spp.
TGDIN

SEQ ID NO: 5698 - protein, 9 aa, Brucella spp.
SKDPPPGTL

SEQ ID NO: 5699 - protein, 18 aa, Brucella spp.
KPVGGSKITDATGNIKVD

SEQ ID NO: 5700 - protein, 5 aa, Brucella spp.
LDNVP

SEQ ID NO: 5701 - protein, 16 aa, Brucella spp.
MTEPVDRSGPAKREQK

SEQ ID NO: 5702 - protein, 7 aa, Brucella spp.
DDKTRNA

SEQ ID NO: 5703 - protein, 10 aa, Brucella spp.
MENGGKRHVS

SEQ ID NO: 5704 - protein, 7 aa, Brucella spp.
AGIPAKA

SEQ ID NO: 5705 - protein, 6 aa, Brucella spp.
SDRGEF

SEQ ID NO: 5706 - protein, 9 aa, Brucella spp.
AFGAKGNLS

SEQ ID NO: 5707 - protein, 7 aa, Brucella spp.
GDFQSAD

SEQ ID NO: 5708 - protein, 16 aa, Brucella spp.
RSDNLSVKATKSGNSF

SEQ ID NO: 5709 - protein, 5 aa, Brucella spp.
GSQFD

SEQ ID NO: 5710 - protein, 15 aa, Brucella spp.
LEAKKSGGGRANSPR

SEQ ID NO: 5711 - protein, 11 aa, Brucella spp.
YESAGSKVSGI

SEQ ID NO: 5712 - protein, 9 aa, Brucella spp.
VTSSGQPFV

SEQ ID NO: 5713 - protein, 19 aa, Brucella spp.
TNNDQGDARSISLQSNDAG

SEQ ID NO: 5714 - protein, 10 aa, Brucella spp.
AQGNGPLRGQ

SEQ ID NO: 5715 - protein, 14 aa, Brucella spp.
SSSPSSGGASLTQA

SEQ ID NO: 5716 - protein, 5 aa, Brucella spp.
VRGPA

SEQ ID NO: 5717 - protein, 6 aa, Brucella spp.
DQQGNM

SEQ ID NO: 5718 - protein, 5 aa, Brucella spp.
NGRDR

SEQ ID NO: 5719 - protein, 6 aa, Brucella spp.
NAKQPQ

SEQ ID NO: 5720 - protein, 7 aa, Brucella spp.
PSDHGEI

SEQ ID NO: 5721 - protein, 9 aa, Brucella spp.
KDDTSGCTR

SEQ ID NO: 5722 - protein, 10 aa, Brucella spp.
SPDSATKHAR

SEQ ID NO: 5723 - protein, 14 aa, Brucella spp.
DGHAQAVLEAARRL

SEQ ID NO: 5724 - protein, 4 aa, Brucella spp.
TLND

SEQ ID NO: 5725 - protein, 19 aa, Brucella spp.
GEEEGDKSIVEDAEKTIRD

SEQ ID NO: 5726 - protein, 4 aa, Brucella spp.
EIDR

SEQ ID NO: 5727 - protein, 8 aa, Brucella spp.
GEADANDT

SEQ ID NO: 5728 - protein, 9 aa, Brucella spp.
GAGGTESQD

SEQ ID NO: 5729 - protein, 6 aa, Brucella spp.
ERNGRK

SEQ ID NO: 5730 - protein, 8 aa, Brucella spp.
EGEEAGIK

SEQ ID NO: 5731 - protein, 10 aa, Brucella spp.
PYDSNARRHT

SEQ ID NO: 5732 - protein, 17 aa, Brucella spp.
YRASGAGGQHVNTTDSA

SEQ ID NO: 5733 - protein, 12 aa, Brucella spp.
AERSQHKNREKA

SEQ ID NO: 5734 - protein, 17 aa, Brucella spp.
KKREEATDAANATKTDI

SEQ ID NO: 5735 - protein, 11 aa, Brucella spp.
TGVESTNPQEV

SEQ ID NO: 5736 - protein, 12 aa, Brucella spp.
IQGGGEMIEDID

SEQ ID NO: 5737 - protein, 4 aa, Brucella spp.
PEET

SEQ ID NO: 5738 - protein, 8 aa, Brucella spp.
SEHKKQLK

SEQ ID NO: 5739 - protein, 4 aa, Brucella spp.
VEPS

SEQ ID NO: 5740 - protein, 62 aa, Brucella spp.
AKAARAEDDEDEPRAKSDRSERNDRARRNRRRGGRRDGQNGEAQANGADKDLPAAEPVGPGF

SEQ ID NO: 5741 - protein, 13 aa, Brucella spp.
AGTPAAALTQKGD

SEQ ID NO: 5742 - protein, 14 aa, Brucella spp.
LDNGDDDDVENEED

SEQ ID NO: 5743 - protein, 9 aa, Brucella spp.
SVGSEDALE

SEQ ID NO: 5744 - protein, 12 aa, Brucella spp.
ELPTHTRTHRRQ

SEQ ID NO: 5745 - protein, 10 aa, Brucella spp.
EERGNKGAAL

SEQ ID NO: 5746 - protein, 10 aa, Brucella spp.
NTARGGGISR

SEQ ID NO: 5747 - protein, 11 aa, Brucella spp.
KITNPQDRKRL

SEQ ID NO: 5748 - protein, 13 aa, Brucella spp.
AGANRTKAEVKRD

SEQ ID NO: 5749 - protein, 5 aa, Brucella spp.
QSTAP

SEQ ID NO: 5750 - protein, 8 aa, Brucella spp.
GENGYREA

SEQ ID NO: 5751 - protein, 14 aa, Brucella spp.
NSGRSTREHSIEDT

SEQ ID NO: 5752 - protein, 4 aa, Brucella spp.
LQTN

SEQ ID NO: 5753 - protein, 6 aa, Brucella spp.
EAAEEV

SEQ ID NO: 5754 - protein, 10 aa, Brucella spp.
EKRNNRAVEK

SEQ ID NO: 5755 - protein, 5 aa, Brucella spp.
DDRAR

SEQ ID NO: 5756 - protein, 8 aa, Brucella spp.
TGHIRSDS

SEQ ID NO: 5757 - protein, 5 aa, Brucella spp.
TPAAS

SEQ ID NO: 5758 - protein, 7 aa, Brucella spp.
ADESVGN

SEQ ID NO: 5759 - protein, 12 aa, Brucella spp.
GAPSTRPVTPSA

SEQ ID NO: 5760 - protein, 7 aa, Brucella spp.
IEDPEIP

SEQ ID NO: 5761 - protein, 107 aa, Brucella spp.
VEEDETEEEARTDVQAGEERSEENDRKRRRRRRRRGGRERDGRDLSAQEEAVSEEASEEDNETDQANEAVSSASMSEEDRRKKRRRGRRGGRKNRREDDNRARRIPD

SEQ ID NO: 5762 - protein, 5 aa, Brucella spp.
EESIG

SEQ ID NO: 5763 - protein, 55 aa, Brucella spp.
AAPEEKPEKPARKTRTRKKAVDEAPADEAAAPAEEVVPEKPKRRTRKAAAKPVVE

SEQ ID NO: 5764 - protein, 14 aa, Brucella spp.
AEVKETVAAETQVE

SEQ ID NO: 5765 - protein, 34 aa, Brucella spp.
TIAEPKSTEPVVTSSESEDRKPKRSGWWQKKGFF

SEQ ID NO: 5766 - protein, 12 aa, Brucella spp.
FPASAQARGGGV

SEQ ID NO: 5767 - protein, 4 aa, Brucella spp.
LGKR

SEQ ID NO: 5768 - protein, 6 aa, Brucella spp.
AETPNE

SEQ ID NO: 5769 - protein, 12 aa, Brucella spp.
GHLAGGHQDRLR

SEQ ID NO: 5770 - protein, 19 aa, Brucella spp.
VAGAAGGSGNAAGAGAGIA

SEQ ID NO: 5771 - protein, 7 aa, Brucella spp.
RTEEMTA

SEQ ID NO: 5772 - protein, 9 aa, Brucella spp.
ATGQSTKGM

SEQ ID NO: 5773 - protein, 6 aa, Brucella spp.
LSGTQI

SEQ ID NO: 5774 - protein, 14 aa, Brucella spp.
KKSPYYNKTDSPAF

SEQ ID NO: 5775 - protein, 6 aa, Brucella spp.
AYSGNM

SEQ ID NO: 5776 - protein, 13 aa, Brucella spp.
NNPGGLAARYGSA

SEQ ID NO: 5777 - protein, 8 aa, Brucella spp.
GSARAALP

SEQ ID NO: 5778 - protein, 7 aa, Brucella spp.
EQPKNPY

SEQ ID NO: 5779 - protein, 10 aa, Brucella spp.
NDAAGAAKAF

SEQ ID NO: 5780 - protein, 6 aa, Brucella spp.
LDPHKS

SEQ ID NO: 5781 - protein, 6 aa, Brucella spp.
KANMPA

SEQ ID NO: 5782 - protein, 10 aa, Brucella spp.
IASDPEFPDG

SEQ ID NO: 5783 - protein, 8 aa, Brucella spp.
YGQQGDMA

SEQ ID NO: 5784 - protein, 10 aa, Brucella spp.
KQMKPGTPDW

SEQ ID NO: 5785 - protein, 16 aa, Brucella spp.
GTARQASKPVQAATST

SEQ ID NO: 5786 - protein, 12 aa, Brucella spp.
LETKQAHAAQEQ

SEQ ID NO: 5787 - protein, 8 aa, Brucella spp.
FGNPNGDV

SEQ ID NO: 5788 - protein, 5 aa, Brucella spp.
KDPNV

SEQ ID NO: 5789 - protein, 10 aa, Brucella spp.
HGRATEESAI

SEQ ID NO: 5790 - protein, 18 aa, Brucella spp.
LGADEAKLREKMKDPAIT

SEQ ID NO: 5791 - protein, 7 aa, Brucella spp.
ITGTPSY

SEQ ID NO: 5792 - protein, 5 aa, Brucella spp.
REPGI

SEQ ID NO: 5793 - protein, 8 aa, Brucella spp.
SCKREAGQ

SEQ ID NO: 5794 - protein, 6 aa, Brucella spp.
QSNHEG

SEQ ID NO: 5795 - protein, 6 aa, Brucella spp.
EAGEKN

SEQ ID NO: 5796 - protein, 4 aa, Brucella spp.
YSHT

SEQ ID NO: 5797 - protein, 14 aa, Brucella spp.
AKEEENNGQSIKGA

SEQ ID NO: 5798 - protein, 8 aa, Brucella spp.
GPPPSRDS

SEQ ID NO: 5799 - protein, 8 aa, Brucella spp.
EAKRTAKR

SEQ ID NO: 5800 - protein, 12 aa, Brucella spp.
PGSDGGVTDEVE

SEQ ID NO: 5801 - protein, 9 aa, Brucella spp.
SAGGGGRGM

SEQ ID NO: 5802 - protein, 5 aa, Brucella spp.
RSAEE

SEQ ID NO: 5803 - protein, 10 aa, Brucella spp.
ARSEAGAAFG

SEQ ID NO: 5804 - protein, 7 aa, Brucella spp.
GDGAGNA

SEQ ID NO: 5805 - protein, 14 aa, Brucella spp.
EEGNSPALNAEARE

SEQ ID NO: 5806 - protein, 4 aa, Brucella spp.
YRGA

SEQ ID NO: 5807 - protein, 6 aa, Brucella spp.
FAPSPG

SEQ ID NO: 5808 - protein, 5 aa, Brucella spp.
TPGGL

SEQ ID NO: 5809 - protein, 7 aa, Brucella spp.
QDIANGD

SEQ ID NO: 5810 - protein, 7 aa, Brucella spp.
GKDRIKR

SEQ ID NO: 5811 - protein, 7 aa, Brucella spp.
AERISNP

SEQ ID NO: 5812 - protein, 11 aa, Brucella spp.
SRTEDEAPRTD

SEQ ID NO: 5813 - protein, 5 aa, Brucella spp.
SPGLN

SEQ ID NO: 5814 - protein, 13 aa, Brucella spp.
KQKSDVPPPNQRN

SEQ ID NO: 5815 - protein, 8 aa, Brucella spp.
GERVGEDE

SEQ ID NO: 5816 - protein, 11 aa, Brucella spp.
QGGKDSEGRTR

SEQ ID NO: 5817 - protein, 9 aa, Brucella spp.
SEASTIPPG

SEQ ID NO: 5818 - protein, 13 aa, Brucella spp.
DTPPSKEDYRPRE

SEQ ID NO: 5819 - protein, 36 aa, Brucella spp.
GSPLAYRPKGSIALPGAQPAERPRVTGEYDAWTPGN

SEQ ID NO: 5820 - protein, 5 aa, Brucella spp.
SGATG

SEQ ID NO: 5821 - protein, 8 aa, Brucella spp.
QVTSESKL

SEQ ID NO: 5822 - protein, 16 aa, Brucella spp.
FSGASTAFGAEPNSNV

SEQ ID NO: 5823 - protein, 9 aa, Brucella spp.
GPDNKGQFE

SEQ ID NO: 5824 - protein, 13 aa, Brucella spp.
QDAGKSMHDQHPT

SEQ ID NO: 5825 - protein, 11 aa, Brucella spp.
PDLRSSDEARA

SEQ ID NO: 5826 - protein, 10 aa, Brucella spp.
DGNMDEGSMR

SEQ ID NO: 5827 - protein, 9 aa, Brucella spp.
VRRPGGEFG

SEQ ID NO: 5828 - protein, 4 aa, Brucella spp.
VIDQ

SEQ ID NO: 5829 - protein, 16 aa, Brucella spp.
VKGETRSMRSKEEAHD

SEQ ID NO: 5830 - protein, 7 aa, Brucella spp.
LPELPDV

SEQ ID NO: 5831 - protein, 10 aa, Brucella spp.
AEGRDGKAAA

SEQ ID NO: 5832 - protein, 16 aa, Brucella spp.
NKAGKDIEESPISPAQ

SEQ ID NO: 5833 - protein, 6 aa, Brucella spp.
GTISGK

SEQ ID NO: 5834 - protein, 12 aa, Brucella spp.
EGGDPKKLVEER

SEQ ID NO: 5835 - protein, 11 aa, Brucella spp.
KQVTDTGAIEK

SEQ ID NO: 5836 - protein, 16 aa, Brucella spp.
AANPDKVEQAKAKPTL

SEQ ID NO: 5837 - protein, 11 aa, Brucella spp.
ATGGKANPQAV

SEQ ID NO: 5838 - protein, 10 aa, Brucella spp.
RLETARGRAR

SEQ ID NO: 5839 - protein, 9 aa, Brucella spp.
FRPGKVPTA

SEQ ID NO: 5840 - protein, 7 aa, Brucella spp.
NDSSRSI

SEQ ID NO: 5841 - protein, 12 aa, Brucella spp.
AERNEKSATQPE

SEQ ID NO: 5842 - protein, 12 aa, Brucella spp.
EDEKEAEKVLDG

SEQ ID NO: 5843 - protein, 8 aa, Brucella spp.
SDEEVDEQ

SEQ ID NO: 5844 - protein, 21 aa, Brucella spp.
IASSTRTFETKKGKAENEDRV

SEQ ID NO: 5845 - protein, 13 aa, Brucella spp.
DGEPFEGGADNDA

SEQ ID NO: 5846 - protein, 5 aa, Brucella spp.
AGDEK

SEQ ID NO: 5847 - protein, 6 aa, Brucella spp.
AGKEAT

SEQ ID NO: 5848 - protein, 6 aa, Brucella spp.
VAKPNE

SEQ ID NO: 5849 - protein, 7 aa, Brucella spp.
DETAKKL

SEQ ID NO: 5850 - protein, 10 aa, Brucella spp.
IESQYGQITR

SEQ ID NO: 5851 - protein, 6 aa, Brucella spp.
YQFETP

SEQ ID NO: 5852 - protein, 20 aa, Brucella spp.
AGRTFEDEETTEEAAREEYR

SEQ ID NO: 5853 - protein, 12 aa, Brucella spp.
GEKAGVEVTEEE

SEQ ID NO: 5854 - protein, 7 aa, Brucella spp.
RYPGQEK

SEQ ID NO: 5855 - protein, 5 aa, Brucella spp.
TPDAV

SEQ ID NO: 5856 - protein, 47 aa, Brucella spp.
TDKKVSKEELTAEDEDAASEAKPAKKAAAKKKAAPKKKAEEGKSEEA

SEQ ID NO: 5857 - protein, 9 aa, Brucella spp.
AMSNNTDLS

SEQ ID NO: 5858 - protein, 7 aa, Brucella spp.
GLAGSEA

SEQ ID NO: 5859 - protein, 11 aa, Brucella spp.
VRGTDAHKTEQ

SEQ ID NO: 5860 - protein, 10 aa, Brucella spp.
FRSDDAETNA

SEQ ID NO: 5861 - protein, 8 aa, Brucella spp.
HQVPAGGA

SEQ ID NO: 5862 - protein, 6 aa, Brucella spp.
REGFSQ

SEQ ID NO: 5863 - protein, 8 aa, Brucella spp.
TGLPPTEW

SEQ ID NO: 5864 - protein, 8 aa, Brucella spp.
GPLTAPSL

SEQ ID NO: 5865 - protein, 7 aa, Brucella spp.
AAETDAD

SEQ ID NO: 5866 - protein, 11 aa, Brucella spp.
DKVGPGGTGKD

SEQ ID NO: 5867 - protein, 9 aa, Brucella spp.
GDKTDFKEW

SEQ ID NO: 5868 - protein, 4 aa, Brucella spp.
EGTP

SEQ ID NO: 5869 - protein, 8 aa, Brucella spp.
ERGPETLR

SEQ ID NO: 5870 - protein, 7 aa, Brucella spp.
AHNPTVK

SEQ ID NO: 5871 - protein, 6 aa, Brucella spp.
KYGSQT

SEQ ID NO: 5872 - protein, 15 aa, Brucella spp.
EKLSQAAVPPPPTTA

SEQ ID NO: 5873 - protein, 11 aa, Brucella spp.
TDDEPGKRSFQ

SEQ ID NO: 5874 - protein, 25 aa, Brucella spp.
VPKPEGKRLRGKEKTIAKKRALSAR

SEQ ID NO: 5875 - protein, 12 aa, Brucella spp.
PGRAPIDAYGNG

SEQ ID NO: 5876 - protein, 9 aa, Brucella spp.
WEPKNPPLL

SEQ ID NO: 5877 - protein, 9 aa, Brucella spp.
SDPMSTGAA

SEQ ID NO: 5878 - protein, 5 aa, Brucella spp.
GSVVG

SEQ ID NO: 5879 - protein, 7 aa, Brucella spp.
RTQMKKR

SEQ ID NO: 5880 - protein, 11 aa, Brucella spp.
RRGDTVVTGGG

SEQ ID NO: 5881 - protein, 12 aa, Brucella spp.
IAPPEAKTPDLD

SEQ ID NO: 5882 - protein, 4 aa, Brucella spp.
GFPA

SEQ ID NO: 5883 - protein, 5 aa, Brucella spp.
MGKSS

SEQ ID NO: 5884 - protein, 8 aa, Brucella spp.
AAQASVNA

SEQ ID NO: 5885 - protein, 9 aa, Brucella spp.
HDDTSYKSL

SEQ ID NO: 5886 - protein, 12 aa, Brucella spp.
AALEGGVEGRPD

SEQ ID NO: 5887 - protein, 16 aa, Brucella spp.
DNERSTAINPSEAIEE

SEQ ID NO: 5888 - protein, 10 aa, Brucella spp.
STTRGNRSGR

SEQ ID NO: 5889 - protein, 8 aa, Brucella spp.
PETDQSGL

SEQ ID NO: 5890 - protein, 4 aa, Brucella spp.
GTPT

SEQ ID NO: 5891 - protein, 7 aa, Brucella spp.
NSGANMA

SEQ ID NO: 5892 - protein, 7 aa, Brucella spp.
VTYSGTV

SEQ ID NO: 5893 - protein, 5 aa, Brucella spp.
YEYAG

SEQ ID NO: 5894 - protein, 5 aa, Brucella spp.
EAHAP

SEQ ID NO: 5895 - protein, 6 aa, Brucella spp.
CAPEEV

SEQ ID NO: 5896 - protein, 21 aa, Brucella spp.
VTAQGKLSHDARLDERRDGRG

SEQ ID NO: 5897 - protein, 11 aa, Brucella spp.
GKAPVADDSDI

SEQ ID NO: 5898 - protein, 4 aa, Brucella spp.
DRSK

SEQ ID NO: 5899 - protein, 8 aa, Brucella spp.
QTGGSGEV

SEQ ID NO: 5900 - protein, 9 aa, Brucella spp.
SAGLKDKRK

SEQ ID NO: 5901 - protein, 10 aa, Brucella spp.
LTPPDPASQI

SEQ ID NO: 5902 - protein, 19 aa, Brucella spp.
KKRDEAQASADADNNASST

SEQ ID NO: 5903 - protein, 14 aa, Brucella spp.
VGEEEQAGPASPVT

SEQ ID NO: 5904 - protein, 5 aa, Brucella spp.
VQQRK

SEQ ID NO: 5905 - protein, 8 aa, Brucella spp.
GVETSKGT

SEQ ID NO: 5906 - protein, 15 aa, Brucella spp.
GRRRTPGRPVTYGTT

SEQ ID NO: 5907 - protein, 13 aa, Brucella spp.
DPDELTEGEDPLE

SEQ ID NO: 5908 - protein, 6 aa, Brucella spp.
GAGEPS

SEQ ID NO: 5909 - protein, 13 aa, Brucella spp.
PKQQGDDGATGEE

SEQ ID NO: 5910 - protein, 9 aa, Brucella spp.
ASQRQRQAV

SEQ ID NO: 5911 - protein, 10 aa, Brucella spp.
SPQERASALA

SEQ ID NO: 5912 - protein, 4 aa, Brucella spp.
RQNA

SEQ ID NO: 5913 - protein, 9 aa, Brucella spp.
GERPVHEDD

SEQ ID NO: 5914 - protein, 38 aa, Brucella spp.
TPADDNVARNERRHDSQFEDQGRAEPRFDSAQDDPSFD

SEQ ID NO: 5915 - protein, 14 aa, Brucella spp.
YTQPTAHSETVSTA

SEQ ID NO: 5916 - protein, 12 aa, Brucella spp.
RAYGEQSPLEED

SEQ ID NO: 5917 - protein, 9 aa, Brucella spp.
SAEAAPSPE

SEQ ID NO: 5918 - protein, 8 aa, Brucella spp.
DRSEPVPQ

SEQ ID NO: 5919 - protein, 13 aa, Brucella spp.
DYSQARDSSEHAH

SEQ ID NO: 5920 - protein, 22 aa, Brucella spp.
SPAAYGDRQQPIEADAGEYDPT

SEQ ID NO: 5921 - protein, 54 aa, Brucella spp.
AIEPGEQAWREDTGVQDNWQAQDEWPAQNDRLEQNDWPAQNNWNAQQPVDAPAT

SEQ ID NO: 5922 - protein, 9 aa, Brucella spp.
AEPAQQPLS

SEQ ID NO: 5923 - protein, 16 aa, Brucella spp.
DEPQPVASRNSYSDHV

SEQ ID NO: 5924 - protein, 43 aa, Brucella spp.
YAPEQPHQGEPEAPVSEPHLDAPSHAGQGYASRTGEAPAYPYY

SEQ ID NO: 5925 - protein, 23 aa, Brucella spp.
FAPGVAAPGVLSSGPQLKTPQAP

SEQ ID NO: 5926 - protein, 4 aa, Brucella spp.
PFRP

SEQ ID NO: 5927 - protein, 20 aa, Brucella spp.
EAEPETAAAAESTDDDLSGL

SEQ ID NO: 5928 - protein, 10 aa, Brucella spp.
GFEPSGDTFD

SEQ ID NO: 5929 - protein, 10 aa, Brucella spp.
DVADTADEDF

SEQ ID NO: 5930 - protein, 12 aa, Brucella spp.
EEEQEASPAPAY

SEQ ID NO: 5931 - protein, 8 aa, Brucella spp.
SGEDYRPA

SEQ ID NO: 5932 - protein, 16 aa, Brucella spp.
QAPARMPAPEPAPEVE

SEQ ID NO: 5933 - protein, 8 aa, Brucella spp.
ENKVEQTH

SEQ ID NO: 5934 - protein, 13 aa, Brucella spp.
NYGEEEAGTNLSE

SEQ ID NO: 5935 - protein, 12 aa, Brucella spp.
QITEGQSEADRA

SEQ ID NO: 5936 - protein, 9 aa, Brucella spp.
ASTYMPNSG

SEQ ID NO: 5937 - protein, 35 aa, Brucella spp.
AAAGLGAAAAAAAASYRRAGSEAAPAAATTASQDD

SEQ ID NO: 5938 - protein, 38 aa, Brucella spp.
QGAQTMEGGDYGERAAMPTEDDLGGAAEAYRNRPVRGR

SEQ ID NO: 5939 - protein, 8 aa, Brucella spp.
GGGSGEPV

SEQ ID NO: 5940 - protein, 23 aa, Brucella spp.
NQPIKMQPENPGGTTVPNQDKAV

SEQ ID NO: 5941 - protein, 9 aa, Brucella spp.
TLPNNPEQK

SEQ ID NO: 5942 - protein, 41 aa, Brucella spp.
TSGEEPVDISGTDDSEYNATEEPGGNVPQNDAQQAHSGTHE

SEQ ID NO: 5943 - protein, 22 aa, Brucella spp.
AAQPSVADNMAPPAAPAARDEI

SEQ ID NO: 5944 - protein, 26 aa, Brucella spp.
AAGNEPPAPQAQQSATPETPRLPTRA

SEQ ID NO: 5945 - protein, 10 aa, Brucella spp.
VPSRPAEQPV

SEQ ID NO: 5946 - protein, 21 aa, Brucella spp.
VPQRAQASAAPQVASAAGAGG

SEQ ID NO: 5947 - protein, 15 aa, Brucella spp.
SQPSAELAQKSYANI

SEQ ID NO: 5948 - protein, 9 aa, Brucella spp.
ADIQGKGTY

SEQ ID NO: 5949 - protein, 8 aa, Brucella spp.
QAGSKEDA

SEQ ID NO: 5950 - protein, 10 aa, Brucella spp.
LKPKDGGELD

SEQ ID NO: 5951 - protein, 14 aa, Brucella spp.
VEPPRDASHGDIAT

SEQ ID NO: 5952 - protein, 8 aa, Brucella spp.
VGQNPREL

SEQ ID NO: 5953 - protein, 9 aa, Brucella spp.
KADEDVESV

SEQ ID NO: 5954 - protein, 14 aa, Brucella spp.
GTDFGRSRLGAGKK

SEQ ID NO: 5955 - protein, 8 aa, Brucella spp.
SANPTGPM

SEQ ID NO: 5956 - protein, 6 aa, Brucella spp.
GESIGE

SEQ ID NO: 5957 - protein, 4 aa, Brucella spp.
AGEF

SEQ ID NO: 5958 - protein, 19 aa, Brucella spp.
GKLPPPKGQLPEDWEDREQ

SEQ ID NO: 5959 - protein, 7 aa, Brucella spp.
EVGDDID

SEQ ID NO: 5960 - protein, 4 aa, Brucella spp.
HGGY

SEQ ID NO: 5961 - protein, 8 aa, Brucella spp.
AVSDGKAK

SEQ ID NO: 5962 - protein, 6 aa, Brucella spp.
GEPVRM

SEQ ID NO: 5963 - protein, 5 aa, Brucella spp.
EVGRD

SEQ ID NO: 5964 - protein, 5 aa, Brucella spp.
NDAPL

SEQ ID NO: 5965 - protein, 9 aa, Brucella spp.
VTEQSKDNP

SEQ ID NO: 5966 - protein, 6 aa, Brucella spp.
LTDESE

SEQ ID NO: 5967 - protein, 8 aa, Brucella spp.
NRGAENPD

SEQ ID NO: 5968 - protein, 4 aa, Brucella spp.
DPDL

SEQ ID NO: 5969 - protein, 9 aa, Brucella spp.
DSEPGKTAL

SEQ ID NO: 5970 - protein, 7 aa, Brucella spp.
EGGGCSG

SEQ ID NO: 5971 - protein, 6 aa, Brucella spp.
AQTEDD

SEQ ID NO: 5972 - protein, 17 aa, Brucella spp.
RNPNATASCGCGTSFAI

SEQ ID NO: 5973 - protein, 11 aa, Brucella spp.
NDDSEKSRSPF

SEQ ID NO: 5974 - protein, 8 aa, Brucella spp.
KNGHKDEA

SEQ ID NO: 5975 - protein, 8 aa, Brucella spp.
AERGHQGA

SEQ ID NO: 5976 - protein, 10 aa, Brucella spp.
EGDGVAEDDY

SEQ ID NO: 5977 - protein, 12 aa, Brucella spp.
EGSEPGSENAPY

SEQ ID NO: 5978 - protein, 14 aa, Brucella spp.
NGIPGSPVQANPNM

SEQ ID NO: 5979 - protein, 4 aa, Brucella spp.
NFGD

SEQ ID NO: 5980 - protein, 9 aa, Brucella spp.
GEGGERNAV

SEQ ID NO: 5981 - protein, 9 aa, Brucella spp.
RKGNTGAQA

SEQ ID NO: 5982 - protein, 8 aa, Brucella spp.
GEADRRNA

SEQ ID NO: 5983 - protein, 7 aa, Brucella spp.
PPLPHEP

SEQ ID NO: 5984 - protein, 10 aa, Brucella spp.
PFNDPSGDRL

SEQ ID NO: 5985 - protein, 12 aa, Brucella spp.
DKNGGDLPPRRE

SEQ ID NO: 5986 - protein, 7 aa, Brucella spp.
GRNLTET

SEQ ID NO: 5987 - protein, 5 aa, Brucella spp.
PSHTG

SEQ ID NO: 5988 - protein, 13 aa, Brucella spp.
PGPDLGAERAVRE

SEQ ID NO: 5989 - protein, 10 aa, Brucella spp.
LTKPAGSLGR

SEQ ID NO: 5990 - protein, 8 aa, Brucella spp.
GKRTPQVN

SEQ ID NO: 5991 - protein, 5 aa, Brucella spp.
HGVTA

SEQ ID NO: 5992 - protein, 8 aa, Brucella spp.
ITPFPPSV

SEQ ID NO: 5993 - protein, 5 aa, Brucella spp.
AGGAA

SEQ ID NO: 5994 - protein, 16 aa, Brucella spp.
HPTGDITEEAAMDERT

SEQ ID NO: 5995 - protein, 12 aa, Brucella spp.
WVGPGTGSTGEL

SEQ ID NO: 5996 - protein, 4 aa, Brucella spp.
NPEA

SEQ ID NO: 5997 - protein, 7 aa, Brucella spp.
SAEPGHR

SEQ ID NO: 5998 - protein, 7 aa, Brucella spp.
GEGTGAA

SEQ ID NO: 5999 - protein, 10 aa, Brucella spp.
NTDDSLPRNA

SEQ ID NO: 6000 - protein, 8 aa, Brucella spp.
DGLGDTAD

SEQ ID NO: 6001 - protein, 7 aa, Brucella spp.
ASTPDRR

SEQ ID NO: 6002 - protein, 7 aa, Brucella spp.
TEAASRA

SEQ ID NO: 6003 - protein, 15 aa, Brucella spp.
SARPGGLADSMGQPQ

SEQ ID NO: 6004 - protein, 14 aa, Brucella spp.
GGRTGDTLGAAQQI

SEQ ID NO: 6005 - protein, 9 aa, Brucella spp.
NNDSGTTLG

SEQ ID NO: 6006 - protein, 5 aa, Brucella spp.
AASRI

SEQ ID NO: 6007 - protein, 14 aa, Brucella spp.
PGSPISGMNADGTL

SEQ ID NO: 6008 - protein, 6 aa, Brucella spp.
KSANGH

SEQ ID NO: 6009 - protein, 4 aa, Brucella spp.
RVNG

SEQ ID NO: 6010 - protein, 4 aa, Brucella spp.
GASS

SEQ ID NO: 6011 - protein, 12 aa, Brucella spp.
QEDAERAGIDTA

SEQ ID NO: 6012 - protein, 8 aa, Brucella spp.
NGQARAAS

SEQ ID NO: 6013 - protein, 10 aa, Brucella spp.
IRSGNQPEQM

SEQ ID NO: 6014 - protein, 7 aa, Brucella spp.
AARAEEP

SEQ ID NO: 6015 - protein, 5 aa, Brucella spp.
EGAYP

SEQ ID NO: 6016 - protein, 6 aa, Brucella spp.
DGSLSG

SEQ ID NO: 6017 - protein, 11 aa, Brucella spp.
ITEERKKQVDF

SEQ ID NO: 6018 - protein, 28 aa, Brucella spp.
YYNTPPGVAAPKDTDIKGVTKEDLAGKT

SEQ ID NO: 6019 - protein, 14 aa, Brucella spp.
TTHANYAEQTFTDS

SEQ ID NO: 6020 - protein, 8 aa, Brucella spp.
KAYPTAEE

SEQ ID NO: 6021 - protein, 10 aa, Brucella spp.
LDAVNDDSVT

SEQ ID NO: 6022 - protein, 4 aa, Brucella spp.
TPDG

SEQ ID NO: 6023 - protein, 7 aa, Brucella spp.
TYPPDDA

SEQ ID NO: 6024 - protein, 6 aa, Brucella spp.
KGRPEL

SEQ ID NO: 6025 - protein, 10 aa, Brucella spp.
RKNGKYKEIN

SEQ ID NO: 6026 - protein, 12 aa, Brucella spp.
EDVERGKPSPEC

SEQ ID NO: 6027 - protein, 7 aa, Brucella spp.
AGETAGA

SEQ ID NO: 6028 - protein, 8 aa, Brucella spp.
HPHSPRTS

SEQ ID NO: 6029 - protein, 17 aa, Brucella spp.
EESGKLSLSPTVPASVG

SEQ ID NO: 6030 - protein, 11 aa, Brucella spp.
SAGASSVGDDM

SEQ ID NO: 6031 - protein, 5 aa, Brucella spp.
YAPRP

SEQ ID NO: 6032 - protein, 5 aa, Brucella spp.
QIAAS

SEQ ID NO: 6033 - protein, 9 aa, Brucella spp.
DGEAETDIE

SEQ ID NO: 6034 - protein, 11 aa, Brucella spp.
AIAEGRDAGRL

SEQ ID NO: 6035 - protein, 6 aa, Brucella spp.
APGQRQ

SEQ ID NO: 6036 - protein, 5 aa, Brucella spp.
NFSEE

SEQ ID NO: 6037 - protein, 12 aa, Brucella spp.
IGQSQRYSAPTR

SEQ ID NO: 6038 - protein, 5 aa, Brucella spp.
DDATV

SEQ ID NO: 6039 - protein, 6 aa, Brucella spp.
AQAQGI

SEQ ID NO: 6040 - protein, 7 aa, Brucella spp.
KASRASG

SEQ ID NO: 6041 - protein, 17 aa, Brucella spp.
VRGGSHSGNVSARELAE

SEQ ID NO: 6042 - protein, 6 aa, Brucella spp.
ANPARA

SEQ ID NO: 6043 - protein, 11 aa, Brucella spp.
DRGEIAAGKRA

SEQ ID NO: 6044 - protein, 7 aa, Brucella spp.
AFSGEPV

SEQ ID NO: 6045 - protein, 6 aa, Brucella spp.
EKPRRY

SEQ ID NO: 6046 - protein, 7 aa, Brucella spp.
GEHSEND

SEQ ID NO: 6047 - protein, 14 aa, Brucella spp.
IARRRPERLNERQR

SEQ ID NO: 6048 - protein, 12 aa, Brucella spp.
GPVEEKDRSRVE

SEQ ID NO: 6049 - protein, 6 aa, Brucella spp.
EEGAPF

SEQ ID NO: 6050 - protein, 19 aa, Brucella spp.
PLSGGKAASMRASRAVGRP

SEQ ID NO: 6051 - protein, 7 aa, Brucella spp.
YPAHSPH

SEQ ID NO: 6052 - protein, 8 aa, Brucella spp.
GRSANRIR

SEQ ID NO: 6053 - protein, 8 aa, Brucella spp.
LHGGSKGL

SEQ ID NO: 6054 - protein, 5 aa, Brucella spp.
ATGPD

SEQ ID NO: 6055 - protein, 9 aa, Brucella spp.
VSPDGEMGF

SEQ ID NO: 6056 - protein, 4 aa, Brucella spp.
TDRP

SEQ ID NO: 6057 - protein, 8 aa, Brucella spp.
DDGGEGDV

SEQ ID NO: 6058 - protein, 7 aa, Brucella spp.
ENGRQVA

SEQ ID NO: 6059 - protein, 6 aa, Brucella spp.
RGPLRP

SEQ ID NO: 6060 - protein, 6 aa, Brucella spp.
KAARSG

SEQ ID NO: 6061 - protein, 7 aa, Brucella spp.
STTEPGI

SEQ ID NO: 6062 - protein, 8 aa, Brucella spp.
TGKPYGKH

SEQ ID NO: 6063 - protein, 4 aa, Brucella spp.
GEGV

SEQ ID NO: 6064 - protein, 8 aa, Brucella spp.
KAGTQPHL

SEQ ID NO: 6065 - protein, 9 aa, Brucella spp.
PKRGDQRQM

SEQ ID NO: 6066 - protein, 7 aa, Brucella spp.
AGMKGDE

SEQ ID NO: 6067 - protein, 8 aa, Brucella spp.
AGGGERDI

SEQ ID NO: 6068 - protein, 9 aa, Brucella spp.
EGRTSNNRG

SEQ ID NO: 6069 - protein, 4 aa, Brucella spp.
STEL

SEQ ID NO: 6070 - protein, 7 aa, Brucella spp.
TGSSRTF

SEQ ID NO: 6071 - protein, 11 aa, Brucella spp.
MGEEGSGISAI

SEQ ID NO: 6072 - protein, 9 aa, Brucella spp.
RIRTGQSTH

SEQ ID NO: 6073 - protein, 4 aa, Brucella spp.
GSYN

SEQ ID NO: 6074 - protein, 13 aa, Brucella spp.
RDGSAGGGMISGS

SEQ ID NO: 6075 - protein, 10 aa, Brucella spp.
HAQKRGARAY

SEQ ID NO: 6076 - protein, 13 aa, Brucella spp.
AQIRRSTADLEKT

SEQ ID NO: 6077 - protein, 9 aa, Brucella spp.
ANGGKNPAY

SEQ ID NO: 6078 - protein, 18 aa, Brucella spp.
GASGAHAATAAEKAALES

SEQ ID NO: 6079 - protein, 4 aa, Brucella spp.
YRGI

SEQ ID NO: 6080 - protein, 14 aa, Brucella spp.
PLDASEKPASGAVS

SEQ ID NO: 6081 - protein, 13 aa, Brucella spp.
ATRAEGAAKLVRA

SEQ ID NO: 6082 - protein, 6 aa, Brucella spp.
VATDNL

SEQ ID NO: 6083 - protein, 10 aa, Brucella spp.
KAYPEKSEAE

SEQ ID NO: 6084 - protein, 4 aa, Brucella spp.
DEKK

SEQ ID NO: 6085 - protein, 7 aa, Brucella spp.
PPNNPYI

SEQ ID NO: 6086 - protein, 5 aa, Brucella spp.
ARRTN

SEQ ID NO: 6087 - protein, 7 aa, Brucella spp.
PSKAGAA

SEQ ID NO: 6088 - protein, 5 aa, Brucella spp.
GDGGN

SEQ ID NO: 6089 - protein, 5 aa, Brucella spp.
SRGVP

SEQ ID NO: 6090 - protein, 4 aa, Brucella spp.
KTNP

SEQ ID NO: 6091 - protein, 9 aa, Brucella spp.
PRDESGQID

SEQ ID NO: 6092 - protein, 5 aa, Brucella spp.
IRPRT

SEQ ID NO: 6093 - protein, 8 aa, Brucella spp.
EAGPHTHR

SEQ ID NO: 6094 - protein, 15 aa, Brucella spp.
KKAGLALNPATPAEA

SEQ ID NO: 6095 - protein, 5 aa, Brucella spp.
PGFGG

SEQ ID NO: 6096 - protein, 10 aa, Brucella spp.
GITPETAGSV

SEQ ID NO: 6097 - protein, 11 aa, Brucella spp.
VYKGNSVESYR

SEQ ID NO: 6098 - protein, 4 aa, Brucella spp.
TSSD

SEQ ID NO: 6099 - protein, 6 aa, Brucella spp.
HAEPTT

SEQ ID NO: 6100 - protein, 9 aa, Brucella spp.
IATGAISGA

SEQ ID NO: 6101 - protein, 6 aa, Brucella spp.
EAEPVS

SEQ ID NO: 6102 - protein, 14 aa, Brucella spp.
SPGQKGSSAMPHKR

SEQ ID NO: 6103 - protein, 5 aa, Brucella spp.
SHSSV

SEQ ID NO: 6104 - protein, 8 aa, Brucella spp.
RAIGPDTT

SEQ ID NO: 6105 - protein, 8 aa, Brucella spp.
AGVSREDA

SEQ ID NO: 6106 - protein, 6 aa, Brucella spp.
SEEQIR

SEQ ID NO: 6107 - protein, 9 aa, Brucella spp.
YTNSGPDHW

SEQ ID NO: 6108 - protein, 16 aa, Brucella spp.
LSTARRVQQAEWSKPV

SEQ ID NO: 6109 - protein, 6 aa, Brucella spp.
ANAATR

SEQ ID NO: 6110 - protein, 9 aa, Brucella spp.
PDVSNEKIR

SEQ ID NO: 6111 - protein, 6 aa, Brucella spp.
NDPFSS

SEQ ID NO: 6112 - protein, 16 aa, Brucella spp.
EAGHINAESGHGPWPE

SEQ ID NO: 6113 - protein, 7 aa, Brucella spp.
EGPEPGT

SEQ ID NO: 6114 - protein, 6 aa, Brucella spp.
ATAFNA

SEQ ID NO: 6115 - protein, 4 aa, Brucella spp.
EVID

SEQ ID NO: 6116 - protein, 4 aa, Brucella spp.
LDDP

SEQ ID NO: 6117 - protein, 5 aa, Brucella spp.
SPQEI

SEQ ID NO: 6118 - protein, 7 aa, Brucella spp.
EISPDSA

SEQ ID NO: 6119 - protein, 10 aa, Brucella spp.
TNDKLDKDRF

SEQ ID NO: 6120 - protein, 14 aa, Brucella spp.
ENDTPRPSGPTLVK

SEQ ID NO: 6121 - protein, 6 aa, Brucella spp.
ITGQAP

SEQ ID NO: 6122 - protein, 7 aa, Brucella spp.
DTSIPDD

SEQ ID NO: 6123 - protein, 6 aa, Brucella spp.
REKADK

SEQ ID NO: 6124 - protein, 14 aa, Brucella spp.
TNANTSFTRGYKPG

SEQ ID NO: 6125 - protein, 7 aa, Brucella spp.
KRLEGEG

SEQ ID NO: 6126 - protein, 10 aa, Brucella spp.
EGTNPNGSVN

SEQ ID NO: 6127 - protein, 19 aa, Brucella spp.
AHGGDDGRALFAGALGITA

SEQ ID NO: 6128 - protein, 7 aa, Brucella spp.
NTRDITP

SEQ ID NO: 6129 - protein, 6 aa, Brucella spp.
LKPDEY

SEQ ID NO: 6130 - protein, 4 aa, Brucella spp.
EPTF

SEQ ID NO: 6131 - protein, 5 aa, Brucella spp.
YKSSK

SEQ ID NO: 6132 - protein, 17 aa, Brucella spp.
LPTSGPRVIQGPGENAG

SEQ ID NO: 6133 - protein, 5 aa, Brucella spp.
HNHPS

SEQ ID NO: 6134 - protein, 9 aa, Brucella spp.
YQGAATGVG

SEQ ID NO: 6135 - protein, 9 aa, Brucella spp.
GEPDHPKTR

SEQ ID NO: 6136 - protein, 6 aa, Brucella spp.
GVGGYG

SEQ ID NO: 6137 - protein, 12 aa, Brucella spp.
KTSRDGVGGATM

SEQ ID NO: 6138 - protein, 13 aa, Brucella spp.
FDESIEEKRPTVQ

SEQ ID NO: 6139 - protein, 5 aa, Brucella spp.
GAKGD

SEQ ID NO: 6140 - protein, 8 aa, Brucella spp.
PEKEAEAQ

SEQ ID NO: 6141 - protein, 5 aa, Brucella spp.
KTTDD

SEQ ID NO: 6142 - protein, 9 aa, Brucella spp.
LGDEAPEYD

SEQ ID NO: 6143 - protein, 15 aa, Brucella spp.
KHAPLPASNVPQVED

SEQ ID NO: 6144 - protein, 6 aa, Brucella spp.
SPDLSS

SEQ ID NO: 6145 - protein, 9 aa, Brucella spp.
LQVPGGDAG

SEQ ID NO: 6146 - protein, 5 aa, Brucella spp.
GHETK

SEQ ID NO: 6147 - protein, 6 aa, Brucella spp.
DVTPRY

SEQ ID NO: 6148 - protein, 8 aa, Brucella spp.
DPFEGGKQ

SEQ ID NO: 6149 - protein, 12 aa, Brucella spp.
ATGAEPLASTDN

SEQ ID NO: 6150 - protein, 10 aa, Brucella spp.
NFGNPEKPEI

SEQ ID NO: 6151 - protein, 8 aa, Brucella spp.
YNETNGQA

SEQ ID NO: 6152 - protein, 4 aa, Brucella spp.
PTPT

SEQ ID NO: 6153 - protein, 6 aa, Brucella spp.
GGMQDG

SEQ ID NO: 6154 - protein, 6 aa, Brucella spp.
DGTHLG

SEQ ID NO: 6155 - protein, 8 aa, Brucella spp.
RADGPAPF

SEQ ID NO: 6156 - protein, 6 aa, Brucella spp.
KRNGEF

SEQ ID NO: 6157 - protein, 4 aa, Brucella spp.
RNGQ

SEQ ID NO: 6158 - protein, 4 aa, Brucella spp.
SDGG

SEQ ID NO: 6159 - protein, 14 aa, Brucella spp.
KSGKGATLDAGDGL

SEQ ID NO: 6160 - protein, 6 aa, Brucella spp.
AEGAGV

SEQ ID NO: 6161 - protein, 4 aa, Brucella spp.
GGDR

SEQ ID NO: 6162 - protein, 8 aa, Brucella spp.
HQTSIRGR

SEQ ID NO: 6163 - protein, 5 aa, Brucella spp.
FSGRQ

SEQ ID NO: 6164 - protein, 7 aa, Brucella spp.
VAGTASS

SEQ ID NO: 6165 - protein, 9 aa, Brucella spp.
FDGTTTPVA

SEQ ID NO: 6166 - protein, 6 aa, Brucella spp.
ADSSGC

SEQ ID NO: 6167 - protein, 6 aa, Brucella spp.
GGKDSY

SEQ ID NO: 6168 - protein, 7 aa, Brucella spp.
DQGQPNF

SEQ ID NO: 6169 - protein, 7 aa, Brucella spp.
KLPETST

SEQ ID NO: 6170 - protein, 5 aa, Brucella spp.
AEDDL

SEQ ID NO: 6171 - protein, 8 aa, Brucella spp.
SQDGLQRN

SEQ ID NO: 6172 - protein, 7 aa, Brucella spp.
RMPGRKD

SEQ ID NO: 6173 - protein, 16 aa, Brucella spp.
AQADAVPKRTKDFTAN

SEQ ID NO: 6174 - protein, 8 aa, Brucella spp.
DQQASPQV

SEQ ID NO: 6175 - protein, 9 aa, Brucella spp.
KKSKKYDRL

SEQ ID NO: 6176 - protein, 20 aa, Brucella spp.
AAAATSDKSAKFSAKDAKKV

SEQ ID NO: 6177 - protein, 5 aa, Brucella spp.
PGEAR

SEQ ID NO: 6178 - protein, 6 aa, Brucella spp.
AYKEAD

SEQ ID NO: 6179 - protein, 9 aa, Brucella spp.
APSGAGKST

SEQ ID NO: 6180 - protein, 7 aa, Brucella spp.
ERPDSGD

SEQ ID NO: 6181 - protein, 15 aa, Brucella spp.
SCSKLSDDERTAVRR

SEQ ID NO: 6182 - protein, 9 aa, Brucella spp.
RKAAAERAQ

SEQ ID NO: 6183 - protein, 17 aa, Brucella spp.
KRASHRPAELSGGEQQR

SEQ ID NO: 6184 - protein, 12 aa, Brucella spp.
EPTGNLDPTTSS

SEQ ID NO: 6185 - protein, 7 aa, Brucella spp.
NIGAGTG

SEQ ID NO: 6186 - protein, 5 aa, Brucella spp.
IRQGT

SEQ ID NO: 6187 - protein, 6 aa, Brucella spp.
FDHSGG

SEQ ID NO: 6188 - protein, 9 aa, Brucella spp.
SPDGDVTPF

SEQ ID NO: 6189 - protein, 5 aa, Brucella spp.
PDKVD

SEQ ID NO: 6190 - protein, 9 aa, Brucella spp.
APVEEAAAR

SEQ ID NO: 6191 - protein, 8 aa, Brucella spp.
AKMDPGET

SEQ ID NO: 6192 - protein, 12 aa, Brucella spp.
ATVTEPEALPEH

SEQ ID NO: 6193 - protein, 7 aa, Brucella spp.
LGEGSPI

SEQ ID NO: 6194 - protein, 6 aa, Brucella spp.
KNPSGG

SEQ ID NO: 6195 - protein, 7 aa, Brucella spp.
RLKAEGA

SEQ ID NO: 6196 - protein, 11 aa, Brucella spp.
GNGEPKIGAHG

SEQ ID NO: 6197 - protein, 6 aa, Brucella spp.
GPADNR

SEQ ID NO: 6198 - protein, 8 aa, Brucella spp.
AGPEQPGA

SEQ ID NO: 6199 - protein, 12 aa, Brucella spp.
AKRQSEDSAPEI

SEQ ID NO: 6200 - protein, 4 aa, Brucella spp.
IPEP

SEQ ID NO: 6201 - protein, 9 aa, Brucella spp.
MDPEPSLGP

SEQ ID NO: 6202 - protein, 16 aa, Brucella spp.
NALREGESPSERQVGE

SEQ ID NO: 6203 - protein, 8 aa, Brucella spp.
EAARDAGR

SEQ ID NO: 6204 - protein, 8 aa, Brucella spp.
SQGEPRAA

SEQ ID NO: 6205 - protein, 7 aa, Brucella spp.
RAIPGNE

SEQ ID NO: 6206 - protein, 7 aa, Brucella spp.
GHPRRSE

SEQ ID NO: 6207 - protein, 4 aa, Brucella spp.
GKAE

SEQ ID NO: 6208 - protein, 6 aa, Brucella spp.
LIGDEE

SEQ ID NO: 6209 - protein, 8 aa, Brucella spp.
PEEDRQGE

SEQ ID NO: 6210 - protein, 6 aa, Brucella spp.
IETVRE

SEQ ID NO: 6211 - protein, 9 aa, Brucella spp.
AANEAWGKK

SEQ ID NO: 6212 - protein, 6 aa, Brucella spp.
VGSTNA

SEQ ID NO: 6213 - protein, 9 aa, Brucella spp.
RAAGGDPGK

SEQ ID NO: 6214 - protein, 20 aa, Brucella spp.
KQESGRGRRGRAWSTPEGNL

SEQ ID NO: 6215 - protein, 9 aa, Brucella spp.
ATGPAVPPT

SEQ ID NO: 6216 - protein, 10 aa, Brucella spp.
PDDPPYPATS

SEQ ID NO: 6217 - protein, 6 aa, Brucella spp.
GSKCDA

SEQ ID NO: 6218 - protein, 7 aa, Brucella spp.
DEGSRVA

SEQ ID NO: 6219 - protein, 9 aa, Brucella spp.
DSVRSTEAG

SEQ ID NO: 6220 - protein, 8 aa, Brucella spp.
AVSGGQRE

SEQ ID NO: 6221 - protein, 7 aa, Brucella spp.
EGAPTPV

SEQ ID NO: 6222 - protein, 8 aa, Brucella spp.
KDGNVENI

SEQ ID NO: 6223 - protein, 7 aa, Brucella spp.
GLSRTNP

SEQ ID NO: 6224 - protein, 13 aa, Brucella spp.
IGGYAEAAARTFF

SEQ ID NO: 6225 - protein, 9 aa, Brucella spp.
DSEASRRNI

SEQ ID NO: 6226 - protein, 7 aa, Brucella spp.
DNSNPGF

SEQ ID NO: 6227 - protein, 7 aa, Brucella spp.
VEAPTAG

SEQ ID NO: 6228 - protein, 5 aa, Brucella spp.
EQGLQ

SEQ ID NO: 6229 - protein, 7 aa, Brucella spp.
GLPGTSG

SEQ ID NO: 6230 - protein, 9 aa, Brucella spp.
IGAKASEYI

SEQ ID NO: 6231 - protein, 7 aa, Brucella spp.
PSANAAA

SEQ ID NO: 6232 - protein, 9 aa, Brucella spp.
NALPGGDAN

SEQ ID NO: 6233 - protein, 7 aa, Brucella spp.
MEGPTPV

SEQ ID NO: 6234 - protein, 6 aa, Brucella spp.
DEQDMR

SEQ ID NO: 6235 - protein, 5 aa, Brucella spp.
ASGYA

SEQ ID NO: 6236 - protein, 5 aa, Brucella spp.
PRASA

SEQ ID NO: 6237 - protein, 6 aa, Brucella spp.
GPNGVS

SEQ ID NO: 6238 - protein, 5 aa, Brucella spp.
QGALP

SEQ ID NO: 6239 - protein, 8 aa, Brucella spp.
ATRTNTAA

SEQ ID NO: 6240 - protein, 19 aa, Brucella spp.
PNVKRQSIPAQVARTPETA

SEQ ID NO: 6241 - protein, 15 aa, Brucella spp.
TLNYPHEKGPVSPRF

SEQ ID NO: 6242 - protein, 7 aa, Brucella spp.
RYPNGEE

SEQ ID NO: 6243 - protein, 13 aa, Brucella spp.
EAGPRRNDGTRRT

SEQ ID NO: 6244 - protein, 7 aa, Brucella spp.
TETREEL

SEQ ID NO: 6245 - protein, 4 aa, Brucella spp.
RGPN

SEQ ID NO: 6246 - protein, 7 aa, Brucella spp.
IPSGANK

SEQ ID NO: 6247 - protein, 6 aa, Brucella spp.
ASNSKY

SEQ ID NO: 6248 - protein, 5 aa, Brucella spp.
QNTGL

SEQ ID NO: 6249 - protein, 6 aa, Brucella spp.
ETNRPP

SEQ ID NO: 6250 - protein, 7 aa, Brucella spp.
EAAGAEV

SEQ ID NO: 6251 - protein, 10 aa, Brucella spp.
KGGPPKPAAS

SEQ ID NO: 6252 - protein, 11 aa, Brucella spp.
LRPGPNGEAPE

SEQ ID NO: 6253 - protein, 5 aa, Brucella spp.
KAREG

SEQ ID NO: 6254 - protein, 6 aa, Brucella spp.
GGECDL

SEQ ID NO: 6255 - protein, 17 aa, Brucella spp.
FGTDGSRFRENKRAVEN

SEQ ID NO: 6256 - protein, 7 aa, Brucella spp.
RGEDAEI

SEQ ID NO: 6257 - protein, 4 aa, Brucella spp.
SELQ

SEQ ID NO: 6258 - protein, 4 aa, Brucella spp.
SRPY

SEQ ID NO: 6259 - protein, 4 aa, Brucella spp.
TETI

SEQ ID NO: 6260 - protein, 6 aa, Brucella spp.
VDTRGR

SEQ ID NO: 6261 - protein, 11 aa, Brucella spp.
VSATSAEKIGA

SEQ ID NO: 6262 - protein, 12 aa, Brucella spp.
CRQDGAALDPAL

SEQ ID NO: 6263 - protein, 4 aa, Brucella spp.
GIEN

SEQ ID NO: 6264 - protein, 5 aa, Brucella spp.
NPRIE

SEQ ID NO: 6265 - protein, 10 aa, Brucella spp.
GSSAETLGQL

SEQ ID NO: 6266 - protein, 10 aa, Brucella spp.
ALTGEDGRAV

SEQ ID NO: 6267 - protein, 8 aa, Brucella spp.
AKLAQDVG

SEQ ID NO: 6268 - protein, 11 aa, Brucella spp.
PGEGGKAARDM

SEQ ID NO: 6269 - protein, 7 aa, Brucella spp.
HGDAGAH

SEQ ID NO: 6270 - protein, 12 aa, Brucella spp.
AAYTEKSGTWLN

SEQ ID NO: 6271 - protein, 4 aa, Brucella spp.
RVQL

SEQ ID NO: 6272 - protein, 11 aa, Brucella spp.
AGFAPGEAKED

SEQ ID NO: 6273 - protein, 4 aa, Brucella spp.
DSLG

SEQ ID NO: 6274 - protein, 7 aa, Brucella spp.
ITPRSAD

SEQ ID NO: 6275 - protein, 10 aa, Brucella spp.
GKASNPGNGA

SEQ ID NO: 6276 - protein, 6 aa, Brucella spp.
QSLKGA

SEQ ID NO: 6277 - protein, 4 aa, Brucella spp.
GLIE

SEQ ID NO: 6278 - protein, 13 aa, Brucella spp.
SGLRGRGGAGFPT

SEQ ID NO: 6279 - protein, 7 aa, Brucella spp.
KQSDGRP

SEQ ID NO: 6280 - protein, 10 aa, Brucella spp.
DESEPGTCKD

SEQ ID NO: 6281 - protein, 5 aa, Brucella spp.
KNNKC

SEQ ID NO: 6282 - protein, 16 aa, Brucella spp.
LEGKKGQPRLKPPFPA

SEQ ID NO: 6283 - protein, 7 aa, Brucella spp.
GRPNNVG

SEQ ID NO: 6284 - protein, 8 aa, Brucella spp.
HGGGIRGG

SEQ ID NO: 6285 - protein, 10 aa, Brucella spp.
REKKSSFGTG

SEQ ID NO: 6286 - protein, 9 aa, Brucella spp.
GQCTPCREG

SEQ ID NO: 6287 - protein, 7 aa, Brucella spp.
GNAQKRE

SEQ ID NO: 6288 - protein, 19 aa, Brucella spp.
DEYTRNAVQSRNIRLEAAE

SEQ ID NO: 6289 - protein, 9 aa, Brucella spp.
KYPEGRQQS

SEQ ID NO: 6290 - protein, 5 aa, Brucella spp.
EQEGW

SEQ ID NO: 6291 - protein, 5 aa, Brucella spp.
PVGSR

SEQ ID NO: 6292 - protein, 4 aa, Brucella spp.
DGTL

SEQ ID NO: 6293 - protein, 6 aa, Brucella spp.
EDLTPE

SEQ ID NO: 6294 - protein, 25 aa, Brucella spp.
AGKGDTIKPGPQDGRVTSEPASGLT

SEQ ID NO: 6295 - protein, 27 aa, Brucella spp.
LETRKASDAAAAKAKAEAEAATKDGNR

SEQ ID NO: 6296 - protein, 6 aa, Brucella spp.
PQHPAA

SEQ ID NO: 6297 - protein, 4 aa, Brucella spp.
SGAA

SEQ ID NO: 6298 - protein, 6 aa, Brucella spp.
KSQPYE

SEQ ID NO: 6299 - protein, 5 aa, Brucella spp.
KNGDC

SEQ ID NO: 6300 - protein, 10 aa, Brucella spp.
RVGPVSNTDH

SEQ ID NO: 6301 - protein, 10 aa, Brucella spp.
VPPKRGEMKR

SEQ ID NO: 6302 - protein, 6 aa, Brucella spp.
EAPKGE

SEQ ID NO: 6303 - protein, 8 aa, Brucella spp.
DGSNKPYR

SEQ ID NO: 6304 - protein, 8 aa, Brucella spp.
VDYPQREK

SEQ ID NO: 6305 - protein, 6 aa, Brucella spp.
PRQNQR

SEQ ID NO: 6306 - protein, 7 aa, Brucella spp.
ADEDTLV

SEQ ID NO: 6307 - protein, 20 aa, Brucella spp.
APQPKGILDPRTGKPVGSDD

SEQ ID NO: 6308 - protein, 5 aa, Brucella spp.
GELSD

SEQ ID NO: 6309 - protein, 8 aa, Brucella spp.
PRASPRQS

SEQ ID NO: 6310 - protein, 4 aa, Brucella spp.
QMPE

SEQ ID NO: 6311 - protein, 7 aa, Brucella spp.
CANGGGY

SEQ ID NO: 6312 - protein, 6 aa, Brucella spp.
GCPPTA

SEQ ID NO: 6313 - protein, 8 aa, Brucella spp.
QPDPEKLS

SEQ ID NO: 6314 - protein, 11 aa, Brucella spp.
HPGTREDMPSA

SEQ ID NO: 6315 - protein, 6 aa, Brucella spp.
DEGSAT

SEQ ID NO: 6316 - protein, 12 aa, Brucella spp.
HLRPGGTVSGPS

SEQ ID NO: 6317 - protein, 8 aa, Brucella spp.
KPSPGTVE

SEQ ID NO: 6318 - protein, 7 aa, Brucella spp.
TDGANGE

SEQ ID NO: 6319 - protein, 15 aa, Brucella spp.
RGKHKATFTPHVDDG

SEQ ID NO: 6320 - protein, 7 aa, Brucella spp.
GKKYTDK

SEQ ID NO: 6321 - protein, 11 aa, Brucella spp.
HPGGIKERTAR

SEQ ID NO: 6322 - protein, 6 aa, Brucella spp.
GPLGRR

SEQ ID NO: 6323 - protein, 14 aa, Brucella spp.
NAGPNHQHEAQQPE

SEQ ID NO: 6324 - protein, 12 aa, Brucella spp.
TVAKTEAAAPVD

SEQ ID NO: 6325 - protein, 16 aa, Brucella spp.
DAQGRAYATGKRKDAV

SEQ ID NO: 6326 - protein, 11 aa, Brucella spp.
PGTGKITVNDK

SEQ ID NO: 6327 - protein, 6 aa, Brucella spp.
SNRAGQ

SEQ ID NO: 6328 - protein, 12 aa, Brucella spp.
AGGGLSGQAGAV

SEQ ID NO: 6329 - protein, 19 aa, Brucella spp.
ERKKYGKAKARRSFQFSKR

SEQ ID NO: 6330 - protein, 5 aa, Brucella spp.
GTTGL

SEQ ID NO: 6331 - protein, 4 aa, Brucella spp.
AERD

SEQ ID NO: 6332 - protein, 10 aa, Brucella spp.
EAERRNKDLR

SEQ ID NO: 6333 - protein, 7 aa, Brucella spp.
DDASKEA

SEQ ID NO: 6334 - protein, 5 aa, Brucella spp.
HNSTR

SEQ ID NO: 6335 - protein, 6 aa, Brucella spp.
TSTTHR

SEQ ID NO: 6336 - protein, 7 aa, Brucella spp.
KGQRERI

SEQ ID NO: 6337 - protein, 5 aa, Brucella spp.
GCYPT

SEQ ID NO: 6338 - protein, 8 aa, Brucella spp.
SGYTGGGK

SEQ ID NO: 6339 - protein, 7 aa, Brucella spp.
DRNHPDY

SEQ ID NO: 6340 - protein, 6 aa, Brucella spp.
EGSPSL

SEQ ID NO: 6341 - protein, 16 aa, Brucella spp.
AKLPRVDAEELAGKDG

SEQ ID NO: 6342 - protein, 5 aa, Brucella spp.
EDHGQ

SEQ ID NO: 6343 - protein, 18 aa, Brucella spp.
GKGASGAAVQNMNLMLGK

SEQ ID NO: 6344 - protein, 10 aa, Brucella spp.
PEGDPASAGS

SEQ ID NO: 6345 - protein, 4 aa, Brucella spp.
ADRG

SEQ ID NO: 6346 - protein, 8 aa, Brucella spp.
DGNQPAGI

SEQ ID NO: 6347 - protein, 5 aa, Brucella spp.
GPSSS

SEQ ID NO: 6348 - protein, 5 aa, Brucella spp.
PDDNA

SEQ ID NO: 6349 - protein, 4 aa, Brucella spp.
DQNG

SEQ ID NO: 6350 - protein, 22 aa, Brucella spp.
GEAAIAAASQDSGPQEKTGLSD

SEQ ID NO: 6351 - protein, 7 aa, Brucella spp.
YQRETLS

SEQ ID NO: 6352 - protein, 6 aa, Brucella spp.
GGYQPG

SEQ ID NO: 6353 - protein, 4 aa, Brucella spp.
ATRN

SEQ ID NO: 6354 - protein, 5 aa, Brucella spp.
NGTME

SEQ ID NO: 6355 - protein, 7 aa, Brucella spp.
GGTNAES

SEQ ID NO: 6356 - protein, 7 aa, Brucella spp.
EQQPDND

SEQ ID NO: 6357 - protein, 8 aa, Brucella spp.
HDDRRSPP

SEQ ID NO: 6358 - protein, 5 aa, Brucella spp.
SKGPV

SEQ ID NO: 6359 - protein, 4 aa, Brucella spp.
HGFN

SEQ ID NO: 6360 - protein, 18 aa, Brucella spp.
KCDPAAKQVTTKNDPRVT

SEQ ID NO: 6361 - protein, 5 aa, Brucella spp.
KPGVT

SEQ ID NO: 6362 - protein, 6 aa, Brucella spp.
GEIDNA

SEQ ID NO: 6363 - protein, 7 aa, Brucella spp.
LSRTESA

SEQ ID NO: 6364 - protein, 16 aa, Brucella spp.
DKNERIGRNPKTGEEV

SEQ ID NO: 6365 - protein, 9 aa, Brucella spp.
AGEGETTVS

SEQ ID NO: 6366 - protein, 8 aa, Brucella spp.
AAAARAAI

SEQ ID NO: 6367 - protein, 8 aa, Brucella spp.
NAGLQPSD

SEQ ID NO: 6368 - protein, 10 aa, Brucella spp.
TSTPNNTFPA

SEQ ID NO: 6369 - protein, 9 aa, Brucella spp.
EGHGLTSDR

SEQ ID NO: 6370 - protein, 8 aa, Brucella spp.
RSDGNHKE

SEQ ID NO: 6371 - protein, 10 aa, Brucella spp.
DGGPSTTQTV

SEQ ID NO: 6372 - protein, 6 aa, Brucella spp.
ATGLTA

SEQ ID NO: 6373 - protein, 9 aa, Brucella spp.
HGNTSAASV

SEQ ID NO: 6374 - protein, 7 aa, Brucella spp.
ADGRIKK

SEQ ID NO: 6375 - protein, 4 aa, Brucella spp.
ANEA

SEQ ID NO: 6376 - protein, 6 aa, Brucella spp.
PDTPLG

SEQ ID NO: 6377 - protein, 7 aa, Brucella spp.
KGENPAL

SEQ ID NO: 6378 - protein, 8 aa, Brucella spp.
GDQGVPKR

SEQ ID NO: 6379 - protein, 8 aa, Brucella spp.
LDANDAQA

SEQ ID NO: 6380 - protein, 5 aa, Brucella spp.
EALAA

SEQ ID NO: 6381 - protein, 15 aa, Brucella spp.
CTTASTLNPSETLTE

SEQ ID NO: 6382 - protein, 9 aa, Brucella spp.
SVPVGSSRE

SEQ ID NO: 6383 - protein, 9 aa, Brucella spp.
GTPSTTATF

SEQ ID NO: 6384 - protein, 4 aa, Brucella spp.
GKVE

SEQ ID NO: 6385 - protein, 11 aa, Brucella spp.
RTTPTSGKDQT

SEQ ID NO: 6386 - protein, 13 aa, Brucella spp.
SKAPTSLPSAGGS

SEQ ID NO: 6387 - protein, 12 aa, Brucella spp.
NLQRTANKRGVA

SEQ ID NO: 6388 - protein, 7 aa, Brucella spp.
EVDGTQY

SEQ ID NO: 6389 - protein, 6 aa, Brucella spp.
RKDVPT

SEQ ID NO: 6390 - protein, 6 aa, Brucella spp.
TEDEPK

SEQ ID NO: 6391 - protein, 12 aa, Brucella spp.
GESRGAKPRHKS

SEQ ID NO: 6392 - protein, 11 aa, Brucella spp.
KGLTGTNPSVG

SEQ ID NO: 6393 - protein, 12 aa, Brucella spp.
ALGGRPHAEPQA

SEQ ID NO: 6394 - protein, 10 aa, Brucella spp.
VGEAARGATA

SEQ ID NO: 6395 - protein, 7 aa, Brucella spp.
GRTPPCA

SEQ ID NO: 6396 - protein, 11 aa, Brucella spp.
ATDPDERVSGK

SEQ ID NO: 6397 - protein, 7 aa, Brucella spp.
EQAADDL

SEQ ID NO: 6398 - protein, 8 aa, Brucella spp.
RSARKRPE

SEQ ID NO: 6399 - protein, 10 aa, Brucella spp.
IGRKGAGQVA

SEQ ID NO: 6400 - protein, 6 aa, Brucella spp.
GPVSRA

SEQ ID NO: 6401 - protein, 6 aa, Brucella spp.
LEQRSP

SEQ ID NO: 6402 - protein, 5 aa, Brucella spp.
SADTQ

SEQ ID NO: 6403 - protein, 11 aa, Brucella spp.
EEAPDERRAAL

SEQ ID NO: 6404 - protein, 6 aa, Brucella spp.
ETHDGR

SEQ ID NO: 6405 - protein, 5 aa, Brucella spp.
GGAGV

SEQ ID NO: 6406 - protein, 7 aa, Brucella spp.
SGRRVPF

SEQ ID NO: 6407 - protein, 9 aa, Brucella spp.
RDVDSERVE

SEQ ID NO: 6408 - protein, 13 aa, Brucella spp.
ESAGEAEVTSDEI

SEQ ID NO: 6409 - protein, 5 aa, Brucella spp.
ATAGL

SEQ ID NO: 6410 - protein, 9 aa, Brucella spp.
SSPRRGNWD

SEQ ID NO: 6411 - protein, 22 aa, Brucella spp.
DARATGGRRVATNQPVLSPQTV

SEQ ID NO: 6412 - protein, 5 aa, Brucella spp.
ASRGG

SEQ ID NO: 6413 - protein, 7 aa, Brucella spp.
LPQEAGL

SEQ ID NO: 6414 - protein, 5 aa, Brucella spp.
GLPAD

SEQ ID NO: 6415 - protein, 5 aa, Brucella spp.
NDTMQ

SEQ ID NO: 6416 - protein, 5 aa, Brucella spp.
VEGGS

SEQ ID NO: 6417 - protein, 6 aa, Brucella spp.
DRQTPL

SEQ ID NO: 6418 - protein, 5 aa, Brucella spp.
PEYLT

SEQ ID NO: 6419 - protein, 11 aa, Brucella spp.
QSGQEVPPESV

SEQ ID NO: 6420 - protein, 5 aa, Brucella spp.
WNTDD

SEQ ID NO: 6421 - protein, 10 aa, Brucella spp.
DPGKINAMSS

SEQ ID NO: 6422 - protein, 6 aa, Brucella spp.
TPQKSY

SEQ ID NO: 6423 - protein, 6 aa, Brucella spp.
TPGWDR

SEQ ID NO: 6424 - protein, 7 aa, Brucella spp.
KSGVNTP

SEQ ID NO: 6425 - protein, 5 aa, Brucella spp.
STGDG

SEQ ID NO: 6426 - protein, 13 aa, Brucella spp.
MDGSTELALGTDT

SEQ ID NO: 6427 - protein, 12 aa, Brucella spp.
VFKPGAPRLEDQ

SEQ ID NO: 6428 - protein, 8 aa, Brucella spp.
DDVTGSRR

SEQ ID NO: 6429 - protein, 8 aa, Brucella spp.
SGVTEPVE

SEQ ID NO: 6430 - protein, 19 aa, Brucella spp.
FPREKPEVKTDDGSFVANP

SEQ ID NO: 6431 - protein, 5 aa, Brucella spp.
PFTTH

SEQ ID NO: 6432 - protein, 8 aa, Brucella spp.
SQAEAGAD

SEQ ID NO: 6433 - protein, 6 aa, Brucella spp.
AIGTQG

SEQ ID NO: 6434 - protein, 8 aa, Brucella spp.
KGDKKTYY

SEQ ID NO: 6435 - protein, 18 aa, Brucella spp.
PANPEEAVREAEQDIAEG

SEQ ID NO: 6436 - protein, 6 aa, Brucella spp.
GGFRRS

SEQ ID NO: 6437 - protein, 8 aa, Brucella spp.
KAQPSTEQ

SEQ ID NO: 6438 - protein, 8 aa, Brucella spp.
RHRSGGMS

SEQ ID NO: 6439 - protein, 7 aa, Brucella spp.
RRGPDSF

SEQ ID NO: 6440 - protein, 7 aa, Brucella spp.
SAKGDGE

SEQ ID NO: 6441 - protein, 4 aa, Brucella spp.
ARAA

SEQ ID NO: 6442 - protein, 12 aa, Brucella spp.
HLGPRGWQRFEG

SEQ ID NO: 6443 - protein, 4 aa, Brucella spp.
EEHI

SEQ ID NO: 6444 - protein, 5 aa, Brucella spp.
PDQAY

SEQ ID NO: 6445 - protein, 4 aa, Brucella spp.
HGDA

SEQ ID NO: 6446 - protein, 15 aa, Brucella spp.
GQGNFGNIDGDNAAA

SEQ ID NO: 6447 - protein, 10 aa, Brucella spp.
PTYNEEDEEP

SEQ ID NO: 6448 - protein, 5 aa, Brucella spp.
NGSAG

SEQ ID NO: 6449 - protein, 5 aa, Brucella spp.
NIPPH

SEQ ID NO: 6450 - protein, 4 aa, Brucella spp.
DAPV

SEQ ID NO: 6451 - protein, 5 aa, Brucella spp.
TSPEQ

SEQ ID NO: 6452 - protein, 10 aa, Brucella spp.
EQESKTDPAA

SEQ ID NO: 6453 - protein, 7 aa, Brucella spp.
GPDFPTG

SEQ ID NO: 6454 - protein, 6 aa, Brucella spp.
RTGRGA

SEQ ID NO: 6455 - protein, 7 aa, Brucella spp.
KEEGNRG

SEQ ID NO: 6456 - protein, 7 aa, Brucella spp.
RDESAED

SEQ ID NO: 6457 - protein, 7 aa, Brucella spp.
KNRTVDP

SEQ ID NO: 6458 - protein, 8 aa, Brucella spp.
EEDEPKQE

SEQ ID NO: 6459 - protein, 9 aa, Brucella spp.
DLTAEKTDL

SEQ ID NO: 6460 - protein, 5 aa, Brucella spp.
SGTRQ

SEQ ID NO: 6461 - protein, 15 aa, Brucella spp.
EKFGPTTRLGKRRTT

SEQ ID NO: 6462 - protein, 4 aa, Brucella spp.
PTHD

SEQ ID NO: 6463 - protein, 4 aa, Brucella spp.
KEGD

SEQ ID NO: 6464 - protein, 4 aa, Brucella spp.
AETT

SEQ ID NO: 6465 - protein, 11 aa, Brucella spp.
TLPGGRGHGEP

SEQ ID NO: 6466 - protein, 11 aa, Brucella spp.
AVANTRKGKQV

SEQ ID NO: 6467 - protein, 7 aa, Brucella spp.
KAPDEAK

SEQ ID NO: 6468 - protein, 8 aa, Brucella spp.
PEMTRGKG

SEQ ID NO: 6469 - protein, 5 aa, Brucella spp.
KDGGV

SEQ ID NO: 6470 - protein, 14 aa, Brucella spp.
WQDSADRTFNRSKE

SEQ ID NO: 6471 - protein, 6 aa, Brucella spp.
ASAGRL

SEQ ID NO: 6472 - protein, 14 aa, Brucella spp.
VPAKAGTGKMNENS

SEQ ID NO: 6473 - protein, 10 aa, Brucella spp.
ANEPHNGSAD

SEQ ID NO: 6474 - protein, 18 aa, Brucella spp.
LPPSSPYSGFASGDLAQT

SEQ ID NO: 6475 - protein, 11 aa, Brucella spp.
RSPDGRTPQEQ

SEQ ID NO: 6476 - protein, 4 aa, Brucella spp.
QAEQ

SEQ ID NO: 6477 - protein, 4 aa, Brucella spp.
LEKE

SEQ ID NO: 6478 - protein, 7 aa, Brucella spp.
PALSKHE

SEQ ID NO: 6479 - protein, 5 aa, Brucella spp.
ADNHP

SEQ ID NO: 6480 - protein, 4 aa, Brucella spp.
TDQN

SEQ ID NO: 6481 - protein, 8 aa, Brucella spp.
IEVEEEAE

SEQ ID NO: 6482 - protein, 5 aa, Brucella spp.
RRRRG

SEQ ID NO: 6483 - protein, 4 aa, Brucella spp.
EHGG

SEQ ID NO: 6484 - protein, 5 aa, Brucella spp.
AADPD

SEQ ID NO: 6485 - protein, 9 aa, Brucella spp.
YRTSNDSPI

SEQ ID NO: 6486 - protein, 8 aa, Brucella spp.
AAEAGKSV

SEQ ID NO: 6487 - protein, 4 aa, Brucella spp.
FDEE

SEQ ID NO: 6488 - protein, 5 aa, Brucella spp.
EDQKL

SEQ ID NO: 6489 - protein, 6 aa, Brucella spp.
AQPAEE

SEQ ID NO: 6490 - protein, 8 aa, Brucella spp.
HAKAGKPA

SEQ ID NO: 6491 - protein, 8 aa, Brucella spp.
VPGLSDNI

SEQ ID NO: 6492 - protein, 6 aa, Brucella spp.
HDLPSG

SEQ ID NO: 6493 - protein, 4 aa, Brucella spp.
NQQS

SEQ ID NO: 6494 - protein, 16 aa, Brucella spp.
DGTSRRIEKEAGEEAF

SEQ ID NO: 6495 - protein, 16 aa, Brucella spp.
PSLSGRGKSLKSSAPR

SEQ ID NO: 6496 - protein, 6 aa, Brucella spp.
KMQVSK

SEQ ID NO: 6497 - protein, 10 aa, Brucella spp.
AGPSGSGKST

SEQ ID NO: 6498 - protein, 6 aa, Brucella spp.
EEHQKG

SEQ ID NO: 6499 - protein, 7 aa, Brucella spp.
PKKQAEE

SEQ ID NO: 6500 - protein, 19 aa, Brucella spp.
IPEQANKYPGQLSGGQQQR

SEQ ID NO: 6501 - protein, 7 aa, Brucella spp.
PTSALDP

SEQ ID NO: 6502 - protein, 9 aa, Brucella spp.
VEQNSPDEF

SEQ ID NO: 6503 - protein, 16 aa, Brucella spp.
NPQHERTRLFLSQILH

SEQ ID NO: 6504 - protein, 6 aa, Brucella spp.
GSGGTS

SEQ ID NO: 6505 - protein, 7 aa, Brucella spp.
NSDSTYG

SEQ ID NO: 6506 - protein, 7 aa, Brucella spp.
RQMATGQ

SEQ ID NO: 6507 - protein, 6 aa, Brucella spp.
GGAQIK

SEQ ID NO: 6508 - protein, 8 aa, Brucella spp.
SKGQTEAA

SEQ ID NO: 6509 - protein, 4 aa, Brucella spp.
RSGQ

SEQ ID NO: 6510 - protein, 6 aa, Brucella spp.
NQTGQA

SEQ ID NO: 6511 - protein, 11 aa, Brucella spp.
SGASADTLSDV

SEQ ID NO: 6512 - protein, 11 aa, Brucella spp.
ASPNDKGEWSG

SEQ ID NO: 6513 - protein, 5 aa, Brucella spp.
FGDPT

SEQ ID NO: 6514 - protein, 4 aa, Brucella spp.
RDTS

SEQ ID NO: 6515 - protein, 4 aa, Brucella spp.
LAGI

SEQ ID NO: 6516 - protein, 7 aa, Brucella spp.
AGTTTEL

SEQ ID NO: 6517 - protein, 21 aa, Brucella spp.
EANAAYDSGRCDAYTTDQSSL

SEQ ID NO: 6518 - protein, 4 aa, Brucella spp.
ANPD

SEQ ID NO: 6519 - protein, 5 aa, Brucella spp.
QGDAR

SEQ ID NO: 6520 - protein, 12 aa, Brucella spp.
VEEMKKSDNPDI

SEQ ID NO: 6521 - protein, 11 aa, Brucella spp.
AEADTKIGTDL

SEQ ID NO: 6522 - protein, 8 aa, Brucella spp.
IGSGSPLK

SEQ ID NO: 6523 - protein, 14 aa, Brucella spp.
QWNKGGLQYGIPVR

SEQ ID NO: 6524 - protein, 21 aa, Brucella spp.
TMASNGQKYTYGTRGTPTSEA

SEQ ID NO: 6525 - protein, 7 aa, Brucella spp.
LEGSAGT

SEQ ID NO: 6526 - protein, 9 aa, Brucella spp.
TESPASNTF

SEQ ID NO: 6527 - protein, 6 aa, Brucella spp.
AAHKGN

SEQ ID NO: 6528 - protein, 8 aa, Brucella spp.
TKYPSGHS

SEQ ID NO: 6529 - protein, 6 aa, Brucella spp.
GPDDTY

SEQ ID NO: 6530 - protein, 5 aa, Brucella spp.
SHPGH

SEQ ID NO: 6531 - protein, 5 aa, Brucella spp.
FSGSS

SEQ ID NO: 6532 - protein, 7 aa, Brucella spp.
GEHAQAS

SEQ ID NO: 6533 - protein, 12 aa, Brucella spp.
GDRTVSKNDYAG

SEQ ID NO: 6534 - protein, 4 aa, Brucella spp.
QNRG

SEQ ID NO: 6535 - protein, 6 aa, Brucella spp.
YPPENC

SEQ ID NO: 6536 - protein, 5 aa, Brucella spp.
TGRDA

SEQ ID NO: 6537 - protein, 5 aa, Brucella spp.
HDASI

SEQ ID NO: 6538 - protein, 12 aa, Brucella spp.
LQSGAEKVASNA

SEQ ID NO: 6539 - protein, 7 aa, Brucella spp.
SDDPIKS

SEQ ID NO: 6540 - protein, 18 aa, Brucella spp.
DPEPVGQSRHEKKRGSIS

SEQ ID NO: 6541 - protein, 7 aa, Brucella spp.
NYSSGAV

SEQ ID NO: 6542 - protein, 8 aa, Brucella spp.
SHSRQTRE

SEQ ID NO: 6543 - protein, 5 aa, Brucella spp.
EEGDS

SEQ ID NO: 6544 - protein, 9 aa, Brucella spp.
RQRNDASSI

SEQ ID NO: 6545 - protein, 18 aa, Brucella spp.
SPKRSSRRKSGSGSSTPI

SEQ ID NO: 6546 - protein, 8 aa, Brucella spp.
QHKSPQAA

SEQ ID NO: 6547 - protein, 33 aa, Brucella spp.
RPAPKPAPAATAKAENKPAPGKTADTKAPARDY

SEQ ID NO: 6548 - protein, 22 aa, Brucella spp.
VGPVPRPAAPVAPTPQKPVQTA

SEQ ID NO: 6549 - protein, 14 aa, Brucella spp.
AVAAPKPPRPSGSV

SEQ ID NO: 6550 - protein, 23 aa, Brucella spp.
VTPAAPHAMPPRGVNTPANSPSV

SEQ ID NO: 6551 - protein, 7 aa, Brucella spp.
WDRSPAI

SEQ ID NO: 6552 - protein, 13 aa, Brucella spp.
KGREMRSYGKTGR

SEQ ID NO: 6553 - protein, 10 aa, Brucella spp.
GHNKPDSATL

SEQ ID NO: 6554 - protein, 13 aa, Brucella spp.
AKKAPSPASTPAH

SEQ ID NO: 6555 - protein, 5 aa, Brucella spp.
GGSNM

SEQ ID NO: 6556 - protein, 6 aa, Brucella spp.
QAPGFP

SEQ ID NO: 6557 - protein, 16 aa, Brucella spp.
DKAEAGGLAKAEAAGI

SEQ ID NO: 6558 - protein, 10 aa, Brucella spp.
DFASKEAHED

SEQ ID NO: 6559 - protein, 5 aa, Brucella spp.
MDEGP

SEQ ID NO: 6560 - protein, 8 aa, Brucella spp.
DGDTAETL

SEQ ID NO: 6561 - protein, 18 aa, Brucella spp.
AAGEKASNQFSDGMVLSA

SEQ ID NO: 6562 - protein, 13 aa, Brucella spp.
KGTEAGKTGEWAG

SEQ ID NO: 6563 - protein, 6 aa, Brucella spp.
KGQVEQ

SEQ ID NO: 6564 - protein, 5 aa, Brucella spp.
PQDAA

SEQ ID NO: 6565 - protein, 7 aa, Brucella spp.
LPPKEKR

SEQ ID NO: 6566 - protein, 9 aa, Brucella spp.
PFEKDGEFD

SEQ ID NO: 6567 - protein, 6 aa, Brucella spp.
KRFGGG

SEQ ID NO: 6568 - protein, 7 aa, Brucella spp.
DRRETER

SEQ ID NO: 6569 - protein, 10 aa, Brucella spp.
APSPDPRLDG

SEQ ID NO: 6570 - protein, 7 aa, Brucella spp.
EEKGSNF

SEQ ID NO: 6571 - protein, 8 aa, Brucella spp.
APAPAGVA

SEQ ID NO: 6572 - protein, 10 aa, Brucella spp.
YEPKVSPADI

SEQ ID NO: 6573 - protein, 5 aa, Brucella spp.
SDGQY

SEQ ID NO: 6574 - protein, 6 aa, Brucella spp.
DDEQDV

SEQ ID NO: 6575 - protein, 45 aa, Brucella spp.
AETEDDDDAAANGEEEPARIASAAESIQWDSSDGLPDTAGLSGPD

SEQ ID NO: 6576 - protein, 6 aa, Brucella spp.
LPNNPG

SEQ ID NO: 6577 - protein, 17 aa, Brucella spp.
RNLKKRVSNYARGIGHS

SEQ ID NO: 6578 - protein, 4 aa, Brucella spp.
TETE

SEQ ID NO: 6579 - protein, 4 aa, Brucella spp.
HRAP

SEQ ID NO: 6580 - protein, 9 aa, Brucella spp.
GARSRKGDY

SEQ ID NO: 6581 - protein, 6 aa, Brucella spp.
AGAVGR

SEQ ID NO: 6582 - protein, 4 aa, Brucella spp.
DEDY

SEQ ID NO: 6583 - protein, 10 aa, Brucella spp.
LSGKSQSVKD

SEQ ID NO: 6584 - protein, 5 aa, Brucella spp.
AASAD

SEQ ID NO: 6585 - protein, 11 aa, Brucella spp.
HQGINPQTVEE

SEQ ID NO: 6586 - protein, 5 aa, Brucella spp.
QNWGN

SEQ ID NO: 6587 - protein, 10 aa, Brucella spp.
PKADSSLGPA

SEQ ID NO: 6588 - protein, 4 aa, Brucella spp.
DKPC

SEQ ID NO: 6589 - protein, 4 aa, Brucella spp.
VEEQ

SEQ ID NO: 6590 - protein, 6 aa, Brucella spp.
STRAGH

SEQ ID NO: 6591 - protein, 9 aa, Brucella spp.
VPQRGEKKE

SEQ ID NO: 6592 - protein, 6 aa, Brucella spp.
NAREAL

SEQ ID NO: 6593 - protein, 9 aa, Brucella spp.
LAETSSQAR

SEQ ID NO: 6594 - protein, 8 aa, Brucella spp.
TDITPGDD

SEQ ID NO: 6595 - protein, 16 aa, Brucella spp.
HGTPAGEVKNPDAFPA

SEQ ID NO: 6596 - protein, 6 aa, Brucella spp.
GQGQVG

SEQ ID NO: 6597 - protein, 8 aa, Brucella spp.
GVDREAGR

SEQ ID NO: 6598 - protein, 7 aa, Brucella spp.
PFTLPPR

SEQ ID NO: 6599 - protein, 8 aa, Brucella spp.
HRARRKKE

SEQ ID NO: 6600 - protein, 7 aa, Brucella spp.
GIGPTRK

SEQ ID NO: 6601 - protein, 5 aa, Brucella spp.
AVSRA

SEQ ID NO: 6602 - protein, 4 aa, Brucella spp.
ESSD

SEQ ID NO: 6603 - protein, 6 aa, Brucella spp.
GPAGDK

SEQ ID NO: 6604 - protein, 7 aa, Brucella spp.
IGKNRRE

SEQ ID NO: 6605 - protein, 6 aa, Brucella spp.
DEDGQL

SEQ ID NO: 6606 - protein, 29 aa, Brucella spp.
ADGTAGGWVSSKEEDEESRKRWEEPRKSE

SEQ ID NO: 6607 - protein, 13 aa, Brucella spp.
MPTTSVAAEKTIS

SEQ ID NO: 6608 - protein, 4 aa, Brucella spp.
LPPE

SEQ ID NO: 6609 - protein, 12 aa, Brucella spp.
ADTPSRALGETR

SEQ ID NO: 6610 - protein, 7 aa, Brucella spp.
NAIEQGH

SEQ ID NO: 6611 - protein, 4 aa, Brucella spp.
ISAG

SEQ ID NO: 6612 - protein, 9 aa, Brucella spp.
DPENPAAPL

SEQ ID NO: 6613 - protein, 12 aa, Brucella spp.
KNTDDAASIGIE

SEQ ID NO: 6614 - protein, 5 aa, Brucella spp.
QGSGV

SEQ ID NO: 6615 - protein, 8 aa, Brucella spp.
DDAQTTLN

SEQ ID NO: 6616 - protein, 12 aa, Brucella spp.
TDGAVSGSGGCN

SEQ ID NO: 6617 - protein, 6 aa, Brucella spp.
ATVTGE

SEQ ID NO: 6618 - protein, 5 aa, Brucella spp.
TRSYK

SEQ ID NO: 6619 - protein, 12 aa, Brucella spp.
SDKEIARLAQSL

SEQ ID NO: 6620 - protein, 4 aa, Brucella spp.
SGPT

SEQ ID NO: 6621 - protein, 8 aa, Brucella spp.
ENAIAKNR

SEQ ID NO: 6622 - protein, 13 aa, Brucella spp.
GATNPANADEGTI

SEQ ID NO: 6623 - protein, 15 aa, Brucella spp.
ENSVHGSDAPETAAE

SEQ ID NO: 6624 - protein, 6 aa, Brucella spp.
TSGQTF

SEQ ID NO: 6625 - protein, 6 aa, Brucella spp.
STMNQD

SEQ ID NO: 6626 - protein, 7 aa, Brucella spp.
SGAPRSA

SEQ ID NO: 6627 - protein, 7 aa, Brucella spp.
RRADGSI

SEQ ID NO: 6628 - protein, 8 aa, Brucella spp.
AIASTPSG

SEQ ID NO: 6629 - protein, 11 aa, Brucella spp.
EVQRRNVSDGT

SEQ ID NO: 6630 - protein, 4 aa, Brucella spp.
ASAG

SEQ ID NO: 6631 - protein, 8 aa, Brucella spp.
PDSNDPML

SEQ ID NO: 6632 - protein, 11 aa, Brucella spp.
GDSRSHREARV

SEQ ID NO: 6633 - protein, 9 aa, Brucella spp.
SDRADKDPS

SEQ ID NO: 6634 - protein, 6 aa, Brucella spp.
KVTDVS

SEQ ID NO: 6635 - protein, 9 aa, Brucella spp.
QKTDEGETI

SEQ ID NO: 6636 - protein, 7 aa, Brucella spp.
NQGTTLA

SEQ ID NO: 6637 - protein, 15 aa, Brucella spp.
KNIKDRYDARTATLQ

SEQ ID NO: 6638 - protein, 8 aa, Brucella spp.
RGQEPQKL

SEQ ID NO: 6639 - protein, 7 aa, Brucella spp.
LASPETI

SEQ ID NO: 6640 - protein, 20 aa, Brucella spp.
SSPAQAQDALSANYQSDPNA

SEQ ID NO: 6641 - protein, 7 aa, Brucella spp.
NTVTAQG

SEQ ID NO: 6642 - protein, 13 aa, Brucella spp.
TYNQQTRRMTATG

SEQ ID NO: 6643 - protein, 5 aa, Brucella spp.
DGNRI

SEQ ID NO: 6644 - protein, 8 aa, Brucella spp.
VETTDNTR

SEQ ID NO: 6645 - protein, 12 aa, Brucella spp.
ESAERSNGEITT

SEQ ID NO: 6646 - protein, 8 aa, Brucella spp.
CAKNPDKP

SEQ ID NO: 6647 - protein, 4 aa, Brucella spp.
KTVR

SEQ ID NO: 6648 - protein, 7 aa, Brucella spp.
DPTVKRK

SEQ ID NO: 6649 - protein, 6 aa, Brucella spp.
TTAYTK

SEQ ID NO: 6650 - protein, 10 aa, Brucella spp.
DREKTNRGMV

SEQ ID NO: 6651 - protein, 5 aa, Brucella spp.
KGNFD

SEQ ID NO: 6652 - protein, 7 aa, Brucella spp.
YNAQTQV

SEQ ID NO: 6653 - protein, 9 aa, Brucella spp.
LAGDPNEMY

SEQ ID NO: 6654 - protein, 6 aa, Brucella spp.
NADYTN

SEQ ID NO: 6655 - protein, 5 aa, Brucella spp.
NGSWV

SEQ ID NO: 6656 - protein, 9 aa, Brucella spp.
TKPNPYPRI

SEQ ID NO: 6657 - protein, 9 aa, Brucella spp.
NFDPANAGF

SEQ ID NO: 6658 - protein, 4 aa, Brucella spp.
TSST

SEQ ID NO: 6659 - protein, 13 aa, Brucella spp.
ERYAGQLPNEDAQ

SEQ ID NO: 6660 - protein, 13 aa, Brucella spp.
SGYDRVEGGTRAN

SEQ ID NO: 6661 - protein, 6 aa, Brucella spp.
GNFKDS

SEQ ID NO: 6662 - protein, 10 aa, Brucella spp.
ADSGLEDARS

SEQ ID NO: 6663 - protein, 7 aa, Brucella spp.
TSNSTGL

SEQ ID NO: 6664 - protein, 6 aa, Brucella spp.
RGRFGK

SEQ ID NO: 6665 - protein, 6 aa, Brucella spp.
EFEAQQ

SEQ ID NO: 6666 - protein, 7 aa, Brucella spp.
PQPAYGY

SEQ ID NO: 6667 - protein, 12 aa, Brucella spp.
QEVTGSATARIN

SEQ ID NO: 6668 - protein, 6 aa, Brucella spp.
SSGLAY

SEQ ID NO: 6669 - protein, 13 aa, Brucella spp.
TRNPGDEKASHSV

SEQ ID NO: 6670 - protein, 8 aa, Brucella spp.
RKSGNLNQ

SEQ ID NO: 6671 - protein, 4 aa, Brucella spp.
NELT

SEQ ID NO: 6672 - protein, 8 aa, Brucella spp.
DKEVNDAY

SEQ ID NO: 6673 - protein, 6 aa, Brucella spp.
AGFASR

SEQ ID NO: 6674 - protein, 8 aa, Brucella spp.
QSGVTPEH

SEQ ID NO: 6675 - protein, 6 aa, Brucella spp.
VSEQEA

SEQ ID NO: 6676 - protein, 10 aa, Brucella spp.
NGGKKPVATE

SEQ ID NO: 6677 - protein, 7 aa, Brucella spp.
SKRSPAL

SEQ ID NO: 6678 - protein, 7 aa, Brucella spp.
RRQEANA

SEQ ID NO: 6679 - protein, 10 aa, Brucella spp.
CDSTRQQAKG

SEQ ID NO: 6680 - protein, 8 aa, Brucella spp.
LPGEWSKD

SEQ ID NO: 6681 - protein, 18 aa, Brucella spp.
VKAAGVNRTTKPHDTEKG

SEQ ID NO: 6682 - protein, 7 aa, Brucella spp.
RQVSDDR

SEQ ID NO: 6683 - protein, 17 aa, Brucella spp.
GADSPAGQEKKAEELSK

SEQ ID NO: 6684 - protein, 12 aa, Brucella spp.
QELREKATIVNR

SEQ ID NO: 6685 - protein, 5 aa, Brucella spp.
SDGSR

SEQ ID NO: 6686 - protein, 10 aa, Brucella spp.
LRDGQQTPGV

SEQ ID NO: 6687 - protein, 4 aa, Brucella spp.
EDKK

SEQ ID NO: 6688 - protein, 12 aa, Brucella spp.
EGGYPGANPTDT

SEQ ID NO: 6689 - protein, 5 aa, Brucella spp.
RQTAR

SEQ ID NO: 6690 - protein, 12 aa, Brucella spp.
AGVSVSNDPGLS

SEQ ID NO: 6691 - protein, 9 aa, Brucella spp.
TNEENLESI

SEQ ID NO: 6692 - protein, 6 aa, Brucella spp.
KANPEY

SEQ ID NO: 6693 - protein, 6 aa, Brucella spp.
AAYSAG

SEQ ID NO: 6694 - protein, 8 aa, Brucella spp.
TNGGTQPL

SEQ ID NO: 6695 - protein, 5 aa, Brucella spp.
VPGES

SEQ ID NO: 6696 - protein, 7 aa, Brucella spp.
HNDTEQA

SEQ ID NO: 6697 - protein, 9 aa, Brucella spp.
NGIGERCGN

SEQ ID NO: 6698 - protein, 6 aa, Brucella spp.
PASLKS

SEQ ID NO: 6699 - protein, 20 aa, Brucella spp.
RPATEQAPYTGTSAFATKAG

SEQ ID NO: 6700 - protein, 6 aa, Brucella spp.
KEPQTY

SEQ ID NO: 6701 - protein, 11 aa, Brucella spp.
HIPPESVGNSR

SEQ ID NO: 6702 - protein, 8 aa, Brucella spp.
SDQGGKSN

SEQ ID NO: 6703 - protein, 14 aa, Brucella spp.
EREAEGYAYEGADA

SEQ ID NO: 6704 - protein, 6 aa, Brucella spp.
EGHGPV

SEQ ID NO: 6705 - protein, 5 aa, Brucella spp.
GGTAA

SEQ ID NO: 6706 - protein, 8 aa, Brucella spp.
SGDATGAR

SEQ ID NO: 6707 - protein, 4 aa, Brucella spp.
FPPR

SEQ ID NO: 6708 - protein, 4 aa, Brucella spp.
APTQ

SEQ ID NO: 6709 - protein, 13 aa, Brucella spp.
GETPPPGSNRPDR

SEQ ID NO: 6710 - protein, 4 aa, Brucella spp.
DPND

SEQ ID NO: 6711 - protein, 11 aa, Brucella spp.
SETAAEKNSFK

SEQ ID NO: 6712 - protein, 9 aa, Brucella spp.
REGRNKSQA

SEQ ID NO: 6713 - protein, 10 aa, Brucella spp.
SSADGSQIDT

SEQ ID NO: 6714 - protein, 5 aa, Brucella spp.
TTSAN

SEQ ID NO: 6715 - protein, 4 aa, Brucella spp.
SGKV

SEQ ID NO: 6716 - protein, 44 aa, Brucella spp.
NKVANTSPDLQERVTEDLTQGQPQPKRKKGPEPEEDSGGQLSMF

SEQ ID NO: 6717 - protein, 14 aa, Brucella spp.
PGGGVEAGETPEEV

SEQ ID NO: 6718 - protein, 7 aa, Brucella spp.
KEETALD

SEQ ID NO: 6719 - protein, 8 aa, Brucella spp.
REGNAYEK

SEQ ID NO: 6720 - protein, 11 aa, Brucella spp.
SGTEQPGDDAA

SEQ ID NO: 6721 - protein, 10 aa, Brucella spp.
ETANVTDSTL

SEQ ID NO: 6722 - protein, 13 aa, Brucella spp.
SSIEANRGNTPAL

SEQ ID NO: 6723 - protein, 15 aa, Brucella spp.
RAIPKSASDGAPAPL

SEQ ID NO: 6724 - protein, 5 aa, Brucella spp.
LPEPV

SEQ ID NO: 6725 - protein, 7 aa, Brucella spp.
ARSGDIE

SEQ ID NO: 6726 - protein, 7 aa, Brucella spp.
DKATQLA

SEQ ID NO: 6727 - protein, 7 aa, Brucella spp.
LEDNEED

SEQ ID NO: 6728 - protein, 9 aa, Brucella spp.
LSGDEDGRE

SEQ ID NO: 6729 - protein, 5 aa, Brucella spp.
LTPPQ

SEQ ID NO: 6730 - protein, 6 aa, Brucella spp.
FEDMKK

SEQ ID NO: 6731 - protein, 14 aa, Brucella spp.
IGPDGSWRFFTAGQ

SEQ ID NO: 6732 - protein, 5 aa, Brucella spp.
GEEAE

SEQ ID NO: 6733 - protein, 7 aa, Brucella spp.
LGPHELK

SEQ ID NO: 6734 - protein, 5 aa, Brucella spp.
LLTPQ

SEQ ID NO: 6735 - protein, 19 aa, Brucella spp.
GDSPASDNDSIKRDSRFPA

SEQ ID NO: 6736 - protein, 7 aa, Brucella spp.
ASANAGL

SEQ ID NO: 6737 - protein, 8 aa, Brucella spp.
GIAEGEAD

SEQ ID NO: 6738 - protein, 9 aa, Brucella spp.
FDQTGGVSF

SEQ ID NO: 6739 - protein, 6 aa, Brucella spp.
HRGTTR

SEQ ID NO: 6740 - protein, 7 aa, Brucella spp.
PLPPMGT

SEQ ID NO: 6741 - protein, 11 aa, Brucella spp.
IGAMGSSASQI

SEQ ID NO: 6742 - protein, 9 aa, Brucella spp.
DAMDTGNSI

SEQ ID NO: 6743 - protein, 4 aa, Brucella spp.
PSPL

SEQ ID NO: 6744 - protein, 5 aa, Brucella spp.
GQTVG

SEQ ID NO: 6745 - protein, 7 aa, Brucella spp.
VSPPAKL

SEQ ID NO: 6746 - protein, 5 aa, Brucella spp.
FTEAE

SEQ ID NO: 6747 - protein, 7 aa, Brucella spp.
RPRGLNP

SEQ ID NO: 6748 - protein, 8 aa, Brucella spp.
PRPTQDVQ

SEQ ID NO: 6749 - protein, 15 aa, Brucella spp.
TSGEPAALPAGHGAS

SEQ ID NO: 6750 - protein, 7 aa, Brucella spp.
VAPGESH

SEQ ID NO: 6751 - protein, 6 aa, Brucella spp.
SRSTAA

SEQ ID NO: 6752 - protein, 8 aa, Brucella spp.
FSPSATPN

SEQ ID NO: 6753 - protein, 18 aa, Brucella spp.
GRGAEAYEGEVFSLPVKD

SEQ ID NO: 6754 - protein, 7 aa, Brucella spp.
RRHGETS

SEQ ID NO: 6755 - protein, 6 aa, Brucella spp.
GGRSRR

SEQ ID NO: 6756 - protein, 7 aa, Brucella spp.
ERDPHRG

SEQ ID NO: 6757 - protein, 8 aa, Brucella spp.
CAATGRKD

SEQ ID NO: 6758 - protein, 8 aa, Brucella spp.
SPTSGRAV

SEQ ID NO: 6759 - protein, 6 aa, Brucella spp.
AGAPWA

SEQ ID NO: 6760 - protein, 12 aa, Brucella spp.
PRAQTPPDSRSG

SEQ ID NO: 6761 - protein, 8 aa, Brucella spp.
TEATQTRS

SEQ ID NO: 6762 - protein, 9 aa, Brucella spp.
APNAGKSTL

SEQ ID NO: 6763 - protein, 4 aa, Brucella spp.
QTTR

SEQ ID NO: 6764 - protein, 7 aa, Brucella spp.
WGGAKDA

SEQ ID NO: 6765 - protein, 7 aa, Brucella spp.
GGFNENA

SEQ ID NO: 6766 - protein, 4 aa, Brucella spp.
RVDP

SEQ ID NO: 6767 - protein, 5 aa, Brucella spp.
KANGL

SEQ ID NO: 6768 - protein, 6 aa, Brucella spp.
NGSGCK

SEQ ID NO: 6769 - protein, 8 aa, Brucella spp.
ESVPNGPW

SEQ ID NO: 6770 - protein, 18 aa, Brucella spp.
ASTVETERWEERKDGSVR

SEQ ID NO: 6771 - protein, 5 aa, Brucella spp.
RESQK

SEQ ID NO: 6772 - protein, 16 aa, Brucella spp.
KGETVKAIGQAARKEI

SEQ ID NO: 6773 - protein, 18 aa, Brucella spp.
NWGNDPERYREMGLDFPT

SEQ ID NO: 6774 - protein, 4 aa, Brucella spp.
EERT

SEQ ID NO: 6775 - protein, 11 aa, Brucella spp.
SSVQAPARANY

SEQ ID NO: 6776 - protein, 7 aa, Brucella spp.
EASEGEL

SEQ ID NO: 6777 - protein, 10 aa, Brucella spp.
TGSDIKSLND

SEQ ID NO: 6778 - protein, 17 aa, Brucella spp.
RSLETGAARRDAKTELQ

SEQ ID NO: 6779 - protein, 7 aa, Brucella spp.
RSGPDHD

SEQ ID NO: 6780 - protein, 19 aa, Brucella spp.
FAPEKGEGRSKRIAEQSAA

SEQ ID NO: 6781 - protein, 8 aa, Brucella spp.
TLERHGSR

SEQ ID NO: 6782 - protein, 17 aa, Brucella spp.
EQRKSEGRKQRAASYAK

SEQ ID NO: 6783 - protein, 7 aa, Brucella spp.
KALGTGI

SEQ ID NO: 6784 - protein, 9 aa, Brucella spp.
NTPSGKPTM

SEQ ID NO: 6785 - protein, 6 aa, Brucella spp.
GAAKQL

SEQ ID NO: 6786 - protein, 5 aa, Brucella spp.
PAGTN

SEQ ID NO: 6787 - protein, 6 aa, Brucella spp.
AALGTT

SEQ ID NO: 6788 - protein, 5 aa, Brucella spp.
DSVPP

SEQ ID NO: 6789 - protein, 6 aa, Brucella spp.
SSADNT

SEQ ID NO: 6790 - protein, 5 aa, Brucella spp.
RKPMP

SEQ ID NO: 6791 - protein, 8 aa, Brucella spp.
LASGGRHG

SEQ ID NO: 6792 - protein, 7 aa, Brucella spp.
NFGSSIG

SEQ ID NO: 6793 - protein, 14 aa, Brucella spp.
NANKPKPDKTLPLP

SEQ ID NO: 6794 - protein, 9 aa, Brucella spp.
GGPIGDKIG

SEQ ID NO: 6795 - protein, 5 aa, Brucella spp.
KTEKL

SEQ ID NO: 6796 - protein, 4 aa, Brucella spp.
ADLG

SEQ ID NO: 6797 - protein, 6 aa, Brucella spp.
SYETSR

SEQ ID NO: 6798 - protein, 10 aa, Brucella spp.
RSAGKADVGT

SEQ ID NO: 6799 - protein, 12 aa, Brucella spp.
PAYPADKLPPEL

SEQ ID NO: 6800 - protein, 7 aa, Brucella spp.
RYKPDVN

SEQ ID NO: 6801 - protein, 12 aa, Brucella spp.
HRSQKRASGDPY

SEQ ID NO: 6802 - protein, 10 aa, Brucella spp.
IEDTTATRQE

SEQ ID NO: 6803 - protein, 7 aa, Brucella spp.
KAVQAEN

SEQ ID NO: 6804 - protein, 14 aa, Brucella spp.
GIKASVKSRQKKPW

SEQ ID NO: 6805 - protein, 5 aa, Brucella spp.
SKGLS

SEQ ID NO: 6806 - protein, 11 aa, Brucella spp.
ISTPKQNDYRS

SEQ ID NO: 6807 - protein, 5 aa, Brucella spp.
GPSRQ

SEQ ID NO: 6808 - protein, 19 aa, Brucella spp.
YKDRGSANNPHKISTETNA

SEQ ID NO: 6809 - protein, 11 aa, Brucella spp.
QLSEGDNPEEF

SEQ ID NO: 6810 - protein, 5 aa, Brucella spp.
RGATP

SEQ ID NO: 6811 - protein, 6 aa, Brucella spp.
KNGDEV

SEQ ID NO: 6812 - protein, 7 aa, Brucella spp.
AQVPPAA

SEQ ID NO: 6813 - protein, 22 aa, Brucella spp.
TGKARAAIRRATRSAVRKQYSG

SEQ ID NO: 6814 - protein, 8 aa, Brucella spp.
RAGKPFSK

SEQ ID NO: 6815 - protein, 5 aa, Brucella spp.
PGLPR

SEQ ID NO: 6816 - protein, 9 aa, Brucella spp.
GRGELPSTD

SEQ ID NO: 6817 - protein, 21 aa, Brucella spp.
PDYQDTRVTTQNNPAKAGEKG

SEQ ID NO: 6818 - protein, 34 aa, Brucella spp.
PEGGEGAAAKVDPAATTPKPGKRALPIRGTNPDL

SEQ ID NO: 6819 - protein, 8 aa, Brucella spp.
PEGAVPGD

SEQ ID NO: 6820 - protein, 12 aa, Brucella spp.
PALTAYDDQPER

SEQ ID NO: 6821 - protein, 4 aa, Brucella spp.
MSER

SEQ ID NO: 6822 - protein, 8 aa, Brucella spp.
AINSPGSL

SEQ ID NO: 6823 - protein, 6 aa, Brucella spp.
AANDAN

SEQ ID NO: 6824 - protein, 14 aa, Brucella spp.
KESASVSSAKRVNG

SEQ ID NO: 6825 - protein, 21 aa, Brucella spp.
ARQISQGAPITVDRDNDKNPV

SEQ ID NO: 6826 - protein, 10 aa, Brucella spp.
DETLSPDDLK

SEQ ID NO: 6827 - protein, 21 aa, Brucella spp.
VDEPEAAPAQIANAAEEIAEG

SEQ ID NO: 6828 - protein, 8 aa, Brucella spp.
IAEAGEED

SEQ ID NO: 6829 - protein, 7 aa, Brucella spp.
QKEPAWH

SEQ ID NO: 6830 - protein, 9 aa, Brucella spp.
PFLPGSDED

SEQ ID NO: 6831 - protein, 16 aa, Brucella spp.
GLRGANRTGRPFTGDY

SEQ ID NO: 6832 - protein, 8 aa, Brucella spp.
FEARPDDS

SEQ ID NO: 6833 - protein, 12 aa, Brucella spp.
VPPENKPVGSEI

SEQ ID NO: 6834 - protein, 11 aa, Brucella spp.
PFGHGKATDIG

SEQ ID NO: 6835 - protein, 8 aa, Brucella spp.
RYNTNTGV

SEQ ID NO: 6836 - protein, 12 aa, Brucella spp.
SEKAAGSARLSV

SEQ ID NO: 6837 - protein, 4 aa, Brucella spp.
PAVI

SEQ ID NO: 6838 - protein, 26 aa, Brucella spp.
NGLDALSAKNVASAIASRNNLPRGSL

SEQ ID NO: 6839 - protein, 21 aa, Brucella spp.
SGMDGVPSTEIAAAASELSGW

SEQ ID NO: 6840 - protein, 6 aa, Brucella spp.
RRNSER

SEQ ID NO: 6841 - protein, 8 aa, Brucella spp.
KENPSSAT

SEQ ID NO: 6842 - protein, 10 aa, Brucella spp.
GSTRPQTTEG

SEQ ID NO: 6843 - protein, 9 aa, Brucella spp.
ATGNSTKAH

SEQ ID NO: 6844 - protein, 9 aa, Brucella spp.
RLSSDDEQK

SEQ ID NO: 6845 - protein, 4 aa, Brucella spp.
EDHQ

SEQ ID NO: 6846 - protein, 9 aa, Brucella spp.
AGPAQAQSL

SEQ ID NO: 6847 - protein, 11 aa, Brucella spp.
AQKSPNAASAI

SEQ ID NO: 6848 - protein, 4 aa, Brucella spp.
WQAN

SEQ ID NO: 6849 - protein, 6 aa, Brucella spp.
ERYNEA

SEQ ID NO: 6850 - protein, 5 aa, Brucella spp.
APRKA

SEQ ID NO: 6851 - protein, 8 aa, Brucella spp.
AAETPTMA

SEQ ID NO: 6852 - protein, 6 aa, Brucella spp.
NQPKLA

SEQ ID NO: 6853 - protein, 8 aa, Brucella spp.
SARPISAS

SEQ ID NO: 6854 - protein, 13 aa, Brucella spp.
AEAGSGGDARAYY

SEQ ID NO: 6855 - protein, 19 aa, Brucella spp.
KLNEKAPELAYPKPTEAER

SEQ ID NO: 6856 - protein, 4 aa, Brucella spp.
RPAV

SEQ ID NO: 6857 - protein, 7 aa, Brucella spp.
VGYGNKA

SEQ ID NO: 6858 - protein, 5 aa, Brucella spp.
ELDSV

SEQ ID NO: 6859 - protein, 4 aa, Brucella spp.
RNDN

SEQ ID NO: 6860 - protein, 4 aa, Brucella spp.
TAAM

SEQ ID NO: 6861 - protein, 13 aa, Brucella spp.
IPASANIKGSGKA

SEQ ID NO: 6862 - protein, 5 aa, Brucella spp.
QESEF

SEQ ID NO: 6863 - protein, 8 aa, Brucella spp.
VSKAGARG

SEQ ID NO: 6864 - protein, 10 aa, Brucella spp.
AKTVATRNGM

SEQ ID NO: 6865 - protein, 11 aa, Brucella spp.
KLTADAAYNAT

SEQ ID NO: 6866 - protein, 9 aa, Brucella spp.
NAGPRRASE

SEQ ID NO: 6867 - protein, 10 aa, Brucella spp.
YGDPRGKSVE

SEQ ID NO: 6868 - protein, 6 aa, Brucella spp.
YSETRN

SEQ ID NO: 6869 - protein, 16 aa, Brucella spp.
LTGRADIKTDLVYGRR

SEQ ID NO: 6870 - protein, 5 aa, Brucella spp.
GDKYA

SEQ ID NO: 6871 - protein, 8 aa, Brucella spp.
SGKNPKHR

SEQ ID NO: 6872 - protein, 5 aa, Brucella spp.
GPHKY

SEQ ID NO: 6873 - protein, 11 aa, Brucella spp.
RERGNSNATIN

SEQ ID NO: 6874 - protein, 5 aa, Brucella spp.
QEEEK

SEQ ID NO: 6875 - protein, 5 aa, Brucella spp.
RCEDS

SEQ ID NO: 6876 - protein, 8 aa, Brucella spp.
SNRSRTVP

SEQ ID NO: 6877 - protein, 13 aa, Brucella spp.
TRRARKASHIPRE

SEQ ID NO: 6878 - protein, 8 aa, Brucella spp.
AEVGLGAD

SEQ ID NO: 6879 - protein, 8 aa, Brucella spp.
FSSPASAL

SEQ ID NO: 6880 - protein, 14 aa, Brucella spp.
STKYQAAKDAGTLG

SEQ ID NO: 6881 - protein, 40 aa, Brucella spp.
AQCGDDAASAPAAAPAAAPATKKAAKAAAPASNDGAKSLT

SEQ ID NO: 6882 - protein, 15 aa, Brucella spp.
AKYQAAKDASTDNGM

SEQ ID NO: 6883 - protein, 34 aa, Brucella spp.
AECGPGADPVALSTDGDSEPAAPSVAAPKGVKFP

SEQ ID NO: 6884 - protein, 12 aa, Brucella spp.
AKYSKESAGKAR

SEQ ID NO: 6885 - protein, 5 aa, Brucella spp.
ANALG

SEQ ID NO: 6886 - protein, 5 aa, Brucella spp.
KGGGY

SEQ ID NO: 6887 - protein, 9 aa, Brucella spp.
APSASPETR

SEQ ID NO: 6888 - protein, 12 aa, Brucella spp.
TIRDSRHFGRNE

SEQ ID NO: 6889 - protein, 6 aa, Brucella spp.
KRPNGT

SEQ ID NO: 6890 - protein, 42 aa, Brucella spp.
GEYKGKSIGTMSGKDGNYKGEVNKLDEGKTYSGKASVKGNTL

SEQ ID NO: 6891 - protein, 7 aa, Brucella spp.
RGEIAPQ

SEQ ID NO: 6892 - protein, 11 aa, Brucella spp.
VSTPGDYSATV

SEQ ID NO: 6893 - protein, 7 aa, Brucella spp.
RESSTPI

SEQ ID NO: 6894 - protein, 5 aa, Brucella spp.
AHVEA

SEQ ID NO: 6895 - protein, 7 aa, Brucella spp.
LAATDDK

SEQ ID NO: 6896 - protein, 9 aa, Brucella spp.
FEPAPGEPM

SEQ ID NO: 6897 - protein, 7 aa, Brucella spp.
TATSASH

SEQ ID NO: 6898 - protein, 9 aa, Brucella spp.
AEGGGGYDQ

SEQ ID NO: 6899 - protein, 15 aa, Brucella spp.
TRAGETAPSTGNPLQ

SEQ ID NO: 6900 - protein, 5 aa, Brucella spp.
AGHGG

SEQ ID NO: 6901 - protein, 10 aa, Brucella spp.
VGPSNAKTIT

SEQ ID NO: 6902 - protein, 7 aa, Brucella spp.
RNSQQLG

SEQ ID NO: 6903 - protein, 8 aa, Brucella spp.
DQRGPVQR

SEQ ID NO: 6904 - protein, 5 aa, Brucella spp.
KPLHG

SEQ ID NO: 6905 - protein, 6 aa, Brucella spp.
SMPDER

SEQ ID NO: 6906 - protein, 14 aa, Brucella spp.
ASEDAHAREAAQPH

SEQ ID NO: 6907 - protein, 8 aa, Brucella spp.
DNGSPEQA

SEQ ID NO: 6908 - protein, 8 aa, Brucella spp.
STPACDPK

SEQ ID NO: 6909 - protein, 6 aa, Brucella spp.
FGGRPV

SEQ ID NO: 6910 - protein, 4 aa, Brucella spp.
EQIE

SEQ ID NO: 6911 - protein, 11 aa, Brucella spp.
NATPWSATTKR

SEQ ID NO: 6912 - protein, 9 aa, Brucella spp.
TPAPPTGPT

SEQ ID NO: 6913 - protein, 8 aa, Brucella spp.
TRQQPIGS

SEQ ID NO: 6914 - protein, 7 aa, Brucella spp.
AGPAGLA

SEQ ID NO: 6915 - protein, 6 aa, Brucella spp.
KGGEVG

SEQ ID NO: 6916 - protein, 12 aa, Brucella spp.
REEEGHPFKTPV

SEQ ID NO: 6917 - protein, 4 aa, Brucella spp.
AGSV

SEQ ID NO: 6918 - protein, 5 aa, Brucella spp.
KAEEL

SEQ ID NO: 6919 - protein, 16 aa, Brucella spp.
DMGVERDGTRGPNYTR

SEQ ID NO: 6920 - protein, 8 aa, Brucella spp.
EGARGSLA

SEQ ID NO: 6921 - protein, 8 aa, Brucella spp.
DEGREPAK

SEQ ID NO: 6922 - protein, 9 aa, Brucella spp.
DPSKHKPGL

SEQ ID NO: 6923 - protein, 6 aa, Brucella spp.
KTGGGS

SEQ ID NO: 6924 - protein, 13 aa, Brucella spp.
DTFEGGKRLSYGA

SEQ ID NO: 6925 - protein, 8 aa, Brucella spp.
AITEGGWQ

SEQ ID NO: 6926 - protein, 4 aa, Brucella spp.
SFPG

SEQ ID NO: 6927 - protein, 4 aa, Brucella spp.
KGSH

SEQ ID NO: 6928 - protein, 11 aa, Brucella spp.
AAGRANDEPIE

SEQ ID NO: 6929 - protein, 6 aa, Brucella spp.
ASAIGK

SEQ ID NO: 6930 - protein, 15 aa, Brucella spp.
HGKTDAQALEPAANY

SEQ ID NO: 6931 - protein, 8 aa, Brucella spp.
IDYPKPDG

SEQ ID NO: 6932 - protein, 8 aa, Brucella spp.
TNHDENEP

SEQ ID NO: 6933 - protein, 7 aa, Brucella spp.
QKTSEHD

SEQ ID NO: 6934 - protein, 8 aa, Brucella spp.
AGPSTRYC

SEQ ID NO: 6935 - protein, 11 aa, Brucella spp.
DGNAAADPGVK

SEQ ID NO: 6936 - protein, 7 aa, Brucella spp.
IKDPNQN

SEQ ID NO: 6937 - protein, 13 aa, Brucella spp.
PPQGGEGPVYMNM

SEQ ID NO: 6938 - protein, 32 aa, Brucella spp.
ATHPAPAQSRMQAAAQQPESNPAQAREERART

SEQ ID NO: 6939 - protein, 12 aa, Brucella spp.
AVPSPSSKPVQA

SEQ ID NO: 6940 - protein, 5 aa, Brucella spp.
LPDNA

SEQ ID NO: 6941 - protein, 11 aa, Brucella spp.
EAASQAETLEE

SEQ ID NO: 6942 - protein, 7 aa, Brucella spp.
DGDPSSD

SEQ ID NO: 6943 - protein, 8 aa, Brucella spp.
APGRDEDM

SEQ ID NO: 6944 - protein, 13 aa, Brucella spp.
WRPPGNRAPTPLE

SEQ ID NO: 6945 - protein, 13 aa, Brucella spp.
GGPAGKALTGAAE

SEQ ID NO: 6946 - protein, 5 aa, Brucella spp.
RTPTG

SEQ ID NO: 6947 - protein, 4 aa, Brucella spp.
PAQK

SEQ ID NO: 6948 - protein, 4 aa, Brucella spp.
EGWS

SEQ ID NO: 6949 - protein, 7 aa, Brucella spp.
RVTNESR

SEQ ID NO: 6950 - protein, 12 aa, Brucella spp.
ALSSAQSPNPLT

SEQ ID NO: 6951 - protein, 5 aa, Brucella spp.
RRSPA

SEQ ID NO: 6952 - protein, 4 aa, Brucella spp.
TSPY

SEQ ID NO: 6953 - protein, 8 aa, Brucella spp.
ANDYADAS

SEQ ID NO: 6954 - protein, 5 aa, Brucella spp.
GPAIS

SEQ ID NO: 6955 - protein, 8 aa, Brucella spp.
PAISDQKT

SEQ ID NO: 6956 - protein, 11 aa, Brucella spp.
TPDGQSTPETM

SEQ ID NO: 6957 - protein, 12 aa, Brucella spp.
DPRAEGTSGQAQ

SEQ ID NO: 6958 - protein, 8 aa, Brucella spp.
RQTPYAIP

SEQ ID NO: 6959 - protein, 11 aa, Brucella spp.
ERRSDTPAGTP

SEQ ID NO: 6960 - protein, 16 aa, Brucella spp.
GKALSDNSFSATPDQL

SEQ ID NO: 6961 - protein, 9 aa, Brucella spp.
VNPTANRQL

SEQ ID NO: 6962 - protein, 8 aa, Brucella spp.
DADRKAAP

SEQ ID NO: 6963 - protein, 7 aa, Brucella spp.
GNPVENG

SEQ ID NO: 6964 - protein, 7 aa, Brucella spp.
VEGQPER

SEQ ID NO: 6965 - protein, 6 aa, Brucella spp.
PHPKPS

SEQ ID NO: 6966 - protein, 8 aa, Brucella spp.
TTRSGRPV

SEQ ID NO: 6967 - protein, 7 aa, Brucella spp.
HGKEGRA

SEQ ID NO: 6968 - protein, 6 aa, Brucella spp.
EKFGRE

SEQ ID NO: 6969 - protein, 11 aa, Brucella spp.
DPETVTDADYA

SEQ ID NO: 6970 - protein, 11 aa, Brucella spp.
FSADQRSRPVK

SEQ ID NO: 6971 - protein, 19 aa, Brucella spp.
QQFPEDAGSLAHPVRPREY

SEQ ID NO: 6972 - protein, 6 aa, Brucella spp.
YEKGSE

SEQ ID NO: 6973 - protein, 7 aa, Brucella spp.
DGDAATI

SEQ ID NO: 6974 - protein, 5 aa, Brucella spp.
SGQDF

SEQ ID NO: 6975 - protein, 7 aa, Brucella spp.
AGTPKVE

SEQ ID NO: 6976 - protein, 10 aa, Brucella spp.
SLAPTPGQSI

SEQ ID NO: 6977 - protein, 18 aa, Brucella spp.
GPDGKDMQPSSVEGGEVR

SEQ ID NO: 6978 - protein, 4 aa, Brucella spp.
RPVP

SEQ ID NO: 6979 - protein, 5 aa, Brucella spp.
PLTAE

SEQ ID NO: 6980 - protein, 6 aa, Brucella spp.
DSDPVA

SEQ ID NO: 6981 - protein, 15 aa, Brucella spp.
AKRVRGGHQPETDPK

SEQ ID NO: 6982 - protein, 18 aa, Brucella spp.
PSESDIAREMGNNVDPDA

SEQ ID NO: 6983 - protein, 5 aa, Brucella spp.
GYADG

SEQ ID NO: 6984 - protein, 18 aa, Brucella spp.
KQEGAFSPDAAPAGKRAL

SEQ ID NO: 6985 - protein, 11 aa, Brucella spp.
QEKSPERAERQ

SEQ ID NO: 6986 - protein, 6 aa, Brucella spp.
NMTDRA

SEQ ID NO: 6987 - protein, 9 aa, Brucella spp.
GDSGEARQA

SEQ ID NO: 6988 - protein, 8 aa, Brucella spp.
TRPGETAL

SEQ ID NO: 6989 - protein, 5 aa, Brucella spp.
NPNRV

SEQ ID NO: 6990 - protein, 14 aa, Brucella spp.
ASNPTGFNRQDGAA

SEQ ID NO: 6991 - protein, 8 aa, Brucella spp.
DPKNPQLS

SEQ ID NO: 6992 - protein, 4 aa, Brucella spp.
REHA

SEQ ID NO: 6993 - protein, 19 aa, Brucella spp.
AGAGKLSTDLRDIIDRTLA

SEQ ID NO: 6994 - protein, 16 aa, Brucella spp.
GTHCESGRKKRKGRLS

SEQ ID NO: 6995 - protein, 4 aa, Brucella spp.
GPAY

SEQ ID NO: 6996 - protein, 6 aa, Brucella spp.
ALSGAT

SEQ ID NO: 6997 - protein, 17 aa, Brucella spp.
NGIETGAQLSAKDLQDA

SEQ ID NO: 6998 - protein, 8 aa, Brucella spp.
SRGLTSSG

SEQ ID NO: 6999 - protein, 12 aa, Brucella spp.
AASGPAGIAGSQ

SEQ ID NO: 7000 - protein, 5 aa, Brucella spp.
PMTAP

SEQ ID NO: 7001 - protein, 15 aa, Brucella spp.
AARAREADDLSGQIQ

SEQ ID NO: 7002 - protein, 7 aa, Brucella spp.
NEEDGDL

SEQ ID NO: 7003 - protein, 9 aa, Brucella spp.
EQAAAGDIS

SEQ ID NO: 7004 - protein, 5 aa, Brucella spp.
IASEG

SEQ ID NO: 7005 - protein, 8 aa, Brucella spp.
AQQTAEAD

SEQ ID NO: 7006 - protein, 4 aa, Brucella spp.
FSEY

SEQ ID NO: 7007 - protein, 13 aa, Brucella spp.
PGVPRNEVDAHTR

SEQ ID NO: 7008 - protein, 14 aa, Brucella spp.
NEHNRAGGQTFERQ

SEQ ID NO: 7009 - protein, 8 aa, Brucella spp.
ERRTQDGG

SEQ ID NO: 7010 - protein, 10 aa, Brucella spp.
ARKGERDRVR

SEQ ID NO: 7011 - protein, 16 aa, Brucella spp.
SLEKERAEAANRAKSE

SEQ ID NO: 7012 - protein, 12 aa, Brucella spp.
TFGPLGSDRYEE

SEQ ID NO: 7013 - protein, 5 aa, Brucella spp.
EEKNI

SEQ ID NO: 7014 - protein, 4 aa, Brucella spp.
TSYG

SEQ ID NO: 7015 - protein, 6 aa, Brucella spp.
ARKTGA

SEQ ID NO: 7016 - protein, 7 aa, Brucella spp.
GVGIPKS

SEQ ID NO: 7017 - protein, 4 aa, Brucella spp.
GQPF

SEQ ID NO: 7018 - protein, 10 aa, Brucella spp.
FTKTHTGSGL

SEQ ID NO: 7019 - protein, 5 aa, Brucella spp.
TERVG

SEQ ID NO: 7020 - protein, 17 aa, Brucella spp.
DRNPAPNAGHDARTHAA

SEQ ID NO: 7021 - protein, 8 aa, Brucella spp.
SQPAAYKT

SEQ ID NO: 7022 - protein, 4 aa, Brucella spp.
EAYG

SEQ ID NO: 7023 - protein, 9 aa, Brucella spp.
NGHTATQRI

SEQ ID NO: 7024 - protein, 6 aa, Brucella spp.
SDGSPY

SEQ ID NO: 7025 - protein, 5 aa, Brucella spp.
ETTSA

SEQ ID NO: 7026 - protein, 8 aa, Brucella spp.
TDAGDRIG

SEQ ID NO: 7027 - protein, 8 aa, Brucella spp.
HGPQGSAA

SEQ ID NO: 7028 - protein, 5 aa, Brucella spp.
REGAR

SEQ ID NO: 7029 - protein, 17 aa, Brucella spp.
SEISNISDQNSGYDEAK

SEQ ID NO: 7030 - protein, 19 aa, Brucella spp.
QPQNPDGSSMKSQSGAYKL

SEQ ID NO: 7031 - protein, 8 aa, Brucella spp.
MGTGSAEG

SEQ ID NO: 7032 - protein, 6 aa, Brucella spp.
NTLDTR

SEQ ID NO: 7033 - protein, 8 aa, Brucella spp.
DKSQTSRM

SEQ ID NO: 7034 - protein, 8 aa, Brucella spp.
GGNTANTS

SEQ ID NO: 7035 - protein, 6 aa, Brucella spp.
KTGDNI

SEQ ID NO: 7036 - protein, 11 aa, Brucella spp.
IKNPETGLSER

SEQ ID NO: 7037 - protein, 6 aa, Brucella spp.
RPYQQT

SEQ ID NO: 7038 - protein, 8 aa, Brucella spp.
PLDPERAS

SEQ ID NO: 7039 - protein, 8 aa, Brucella spp.
ARAREEEL

SEQ ID NO: 7040 - protein, 4 aa, Brucella spp.
KAAD

SEQ ID NO: 7041 - protein, 7 aa, Brucella spp.
SATPESA

SEQ ID NO: 7042 - protein, 13 aa, Brucella spp.
SASGTVAGVSESE

SEQ ID NO: 7043 - protein, 8 aa, Brucella spp.
TETTTDRL

SEQ ID NO: 7044 - protein, 4 aa, Brucella spp.
ACTG

SEQ ID NO: 7045 - protein, 16 aa, Brucella spp.
AAGRINLPDRSNPEKD

SEQ ID NO: 7046 - protein, 5 aa, Brucella spp.
LNYSS

SEQ ID NO: 7047 - protein, 8 aa, Brucella spp.
TKPAIGDP

SEQ ID NO: 7048 - protein, 6 aa, Brucella spp.
DRTGDG

SEQ ID NO: 7049 - protein, 9 aa, Brucella spp.
RPDPGSTPL

SEQ ID NO: 7050 - protein, 7 aa, Brucella spp.
GRGQNWE

SEQ ID NO: 7051 - protein, 11 aa, Brucella spp.
RPVAGDRLSGK

SEQ ID NO: 7052 - protein, 6 aa, Brucella spp.
KGHGDI

SEQ ID NO: 7053 - protein, 5 aa, Brucella spp.
LGRGG

SEQ ID NO: 7054 - protein, 8 aa, Brucella spp.
PELRGNQT

SEQ ID NO: 7055 - protein, 6 aa, Brucella spp.
QARDAL

SEQ ID NO: 7056 - protein, 8 aa, Brucella spp.
PEDDEGFA

SEQ ID NO: 7057 - protein, 4 aa, Brucella spp.
DPAE

SEQ ID NO: 7058 - protein, 8 aa, Brucella spp.
APELGAAS

SEQ ID NO: 7059 - protein, 8 aa, Brucella spp.
VDDPGTLE

SEQ ID NO: 7060 - protein, 6 aa, Brucella spp.
GYERSS

SEQ ID NO: 7061 - protein, 12 aa, Brucella spp.
RATQSAEARERL

SEQ ID NO: 7062 - protein, 8 aa, Brucella spp.
ETRRADES

SEQ ID NO: 7063 - protein, 8 aa, Brucella spp.
GVRAGQAF

SEQ ID NO: 7064 - protein, 10 aa, Brucella spp.
QRRHGKVKGA

SEQ ID NO: 7065 - protein, 10 aa, Brucella spp.
GSRELTAGSD

SEQ ID NO: 7066 - protein, 16 aa, Brucella spp.
DKDAEESDGEKPLAPS

SEQ ID NO: 7067 - protein, 7 aa, Brucella spp.
SAPTAEG

SEQ ID NO: 7068 - protein, 11 aa, Brucella spp.
RPSGNKGPVAT

SEQ ID NO: 7069 - protein, 6 aa, Brucella spp.
KYQRND

SEQ ID NO: 7070 - protein, 5 aa, Brucella spp.
RPIHG

SEQ ID NO: 7071 - protein, 9 aa, Brucella spp.
QEKPPRDDW

SEQ ID NO: 7072 - protein, 4 aa, Brucella spp.
KPGG

SEQ ID NO: 7073 - protein, 9 aa, Brucella spp.
KKTPRPFAT

SEQ ID NO: 7074 - protein, 9 aa, Brucella spp.
AGLDQFPPG

SEQ ID NO: 7075 - protein, 18 aa, Brucella spp.
AEAGHSADIAGDGETGYA

SEQ ID NO: 7076 - protein, 6 aa, Brucella spp.
AENGNY

SEQ ID NO: 7077 - protein, 4 aa, Brucella spp.
KRDG

SEQ ID NO: 7078 - protein, 5 aa, Brucella spp.
AKGME

SEQ ID NO: 7079 - protein, 6 aa, Brucella spp.
EVDDRV

SEQ ID NO: 7080 - protein, 11 aa, Brucella spp.
TGLRAGGDDYL

SEQ ID NO: 7081 - protein, 10 aa, Brucella spp.
RRSSPREADT

SEQ ID NO: 7082 - protein, 7 aa, Brucella spp.
HTARRQS

SEQ ID NO: 7083 - protein, 6 aa, Brucella spp.
IEKGFD

SEQ ID NO: 7084 - protein, 13 aa, Brucella spp.
AGRGKQSAAARAE

SEQ ID NO: 7085 - protein, 18 aa, Brucella spp.
PDEVLSDPKLEKRAREIS

SEQ ID NO: 7086 - protein, 11 aa, Brucella spp.
ESIDDSNAELA

SEQ ID NO: 7087 - protein, 9 aa, Brucella spp.
LTKGDTDGQ

SEQ ID NO: 7088 - protein, 25 aa, Brucella spp.
RAAGTAPQPLSESEKAELSRLLDGK

SEQ ID NO: 7089 - protein, 7 aa, Brucella spp.
NSHSQKP

SEQ ID NO: 7090 - protein, 7 aa, Brucella spp.
GNLPETL

SEQ ID NO: 7091 - protein, 6 aa, Brucella spp.
MEGGDL

SEQ ID NO: 7092 - protein, 6 aa, Brucella spp.
ATDPGR

SEQ ID NO: 7093 - protein, 6 aa, Brucella spp.
TGEKIS

SEQ ID NO: 7094 - protein, 9 aa, Brucella spp.
IGKVSASKA

SEQ ID NO: 7095 - protein, 8 aa, Brucella spp.
PGGTAKVQ

SEQ ID NO: 7096 - protein, 12 aa, Brucella spp.
PITGSNFTENRG

SEQ ID NO: 7097 - protein, 5 aa, Brucella spp.
SSGRD

SEQ ID NO: 7098 - protein, 7 aa, Brucella spp.
MPTTESG

SEQ ID NO: 7099 - protein, 8 aa, Brucella spp.
GDEPGNGA

SEQ ID NO: 7100 - protein, 19 aa, Brucella spp.
VGAPSKVRRSASKEAEAVA

SEQ ID NO: 7101 - protein, 16 aa, Brucella spp.
PKGKGGFARTVSQRKR

SEQ ID NO: 7102 - protein, 11 aa, Brucella spp.
DLTEQDMTSGA

SEQ ID NO: 7103 - protein, 11 aa, Brucella spp.
EEGSVSRTGSE

SEQ ID NO: 7104 - protein, 7 aa, Brucella spp.
EGRFGSD

SEQ ID NO: 7105 - protein, 8 aa, Brucella spp.
HDENYVPK

SEQ ID NO: 7106 - protein, 14 aa, Brucella spp.
LADSLKKKGVWEGK

SEQ ID NO: 7107 - protein, 11 aa, Brucella spp.
QAALPAEKNDL

SEQ ID NO: 7108 - protein, 6 aa, Brucella spp.
SAQQAR

SEQ ID NO: 7109 - protein, 18 aa, Brucella spp.
EKDAMAATADGGQGRSGR

SEQ ID NO: 7110 - protein, 10 aa, Brucella spp.
AAAPDRSSVT

SEQ ID NO: 7111 - protein, 9 aa, Brucella spp.
LAQNPGDVR

SEQ ID NO: 7112 - protein, 7 aa, Brucella spp.
ASDAVSA

SEQ ID NO: 7113 - protein, 14 aa, Brucella spp.
LTAASGGTVTAEAE

SEQ ID NO: 7114 - protein, 10 aa, Brucella spp.
AELSPDDIRP

SEQ ID NO: 7115 - protein, 12 aa, Brucella spp.
EMQDGHPDRAAD

SEQ ID NO: 7116 - protein, 11 aa, Brucella spp.
KAPADAPWRGQ

SEQ ID NO: 7117 - protein, 31 aa, Brucella spp.
DPASAKQAEAKGPSAEDVEAASTLSAGDRQA

SEQ ID NO: 7118 - protein, 10 aa, Brucella spp.
TLRQNGGDID

SEQ ID NO: 7119 - protein, 9 aa, Brucella spp.
RNDAQDALA

SEQ ID NO: 7120 - protein, 9 aa, Brucella spp.
LQGENRTEL

SEQ ID NO: 7121 - protein, 5 aa, Brucella spp.
LNRQL

SEQ ID NO: 7122 - protein, 10 aa, Brucella spp.
SAYDGEEGHY

SEQ ID NO: 7123 - protein, 7 aa, Brucella spp.
GDTEPYD

SEQ ID NO: 7124 - protein, 5 aa, Brucella spp.
RSGRT

SEQ ID NO: 7125 - protein, 5 aa, Brucella spp.
DRWSD

SEQ ID NO: 7126 - protein, 9 aa, Brucella spp.
GIDAGADDY

SEQ ID NO: 7127 - protein, 6 aa, Brucella spp.
AGHASS

SEQ ID NO: 7128 - protein, 10 aa, Brucella spp.
TKTSKASIDG

SEQ ID NO: 7129 - protein, 7 aa, Brucella spp.
FDRDSNT

SEQ ID NO: 7130 - protein, 13 aa, Brucella spp.
RSGGEGEAKGSGS

SEQ ID NO: 7131 - protein, 7 aa, Brucella spp.
MAAPQKP

SEQ ID NO: 7132 - protein, 6 aa, Brucella spp.
DCTAVG

SEQ ID NO: 7133 - protein, 20 aa, Brucella spp.
QVAAQQGGQLAKATPTMQNG

SEQ ID NO: 7134 - protein, 17 aa, Brucella spp.
GRNGERPRRVEVAVPAQ

SEQ ID NO: 7135 - protein, 8 aa, Brucella spp.
GATGGPEW

SEQ ID NO: 7136 - protein, 9 aa, Brucella spp.
GLEKRNARW

SEQ ID NO: 7137 - protein, 8 aa, Brucella spp.
DAGTGLRS

SEQ ID NO: 7138 - protein, 12 aa, Brucella spp.
SSATGKASLSAF

SEQ ID NO: 7139 - protein, 9 aa, Brucella spp.
DQPLGTGDG

SEQ ID NO: 7140 - protein, 6 aa, Brucella spp.
YESYDR

SEQ ID NO: 7141 - protein, 7 aa, Brucella spp.
KVPEGEA

SEQ ID NO: 7142 - protein, 4 aa, Brucella spp.
DTDR

SEQ ID NO: 7143 - protein, 14 aa, Brucella spp.
AGEIPSIPIVEVKR

SEQ ID NO: 7144 - protein, 7 aa, Brucella spp.
ADTSAFD

SEQ ID NO: 7145 - protein, 16 aa, Brucella spp.
DLEKRSSSFGNSLNSA

SEQ ID NO: 7146 - protein, 11 aa, Brucella spp.
KGAITSGKGLE

SEQ ID NO: 7147 - protein, 11 aa, Brucella spp.
SSLAGTALSAG

SEQ ID NO: 7148 - protein, 6 aa, Brucella spp.
LQPLQG

SEQ ID NO: 7149 - protein, 6 aa, Brucella spp.
GVVSSP

SEQ ID NO: 7150 - protein, 11 aa, Brucella spp.
SLGLAGEAGAE

SEQ ID NO: 7151 - protein, 18 aa, Brucella spp.
RGSDGRLGIATGGGSKPV

SEQ ID NO: 7152 - protein, 14 aa, Brucella spp.
TSPDASSFRKSEAQ

SEQ ID NO: 7153 - protein, 4 aa, Brucella spp.
RLDG

SEQ ID NO: 7154 - protein, 7 aa, Brucella spp.
SGRLSAR

SEQ ID NO: 7155 - protein, 13 aa, Brucella spp.
RGGGHTVSEEDVA

SEQ ID NO: 7156 - protein, 8 aa, Brucella spp.
DMRAEGGV

SEQ ID NO: 7157 - protein, 7 aa, Brucella spp.
RDDGTFE

SEQ ID NO: 7158 - protein, 10 aa, Brucella spp.
DVTDADAAGR

SEQ ID NO: 7159 - protein, 14 aa, Brucella spp.
GSGVQRASISGSGI

SEQ ID NO: 7160 - protein, 6 aa, Brucella spp.
DAASDA

SEQ ID NO: 7161 - protein, 8 aa, Brucella spp.
YGGNHDAE

SEQ ID NO: 7162 - protein, 6 aa, Brucella spp.
AVAGSA

SEQ ID NO: 7163 - protein, 4 aa, Brucella spp.
KREA

SEQ ID NO: 7164 - protein, 4 aa, Brucella spp.
ASLA

SEQ ID NO: 7165 - protein, 6 aa, Brucella spp.
QAPLPG

SEQ ID NO: 7166 - protein, 6 aa, Brucella spp.
ATEHEA

SEQ ID NO: 7167 - protein, 8 aa, Brucella spp.
PQGAVEGG

SEQ ID NO: 7168 - protein, 10 aa, Brucella spp.
TVETDADGWP

SEQ ID NO: 7169 - protein, 6 aa, Brucella spp.
LASRTI

SEQ ID NO: 7170 - protein, 4 aa, Brucella spp.
DAPG

SEQ ID NO: 7171 - protein, 9 aa, Brucella spp.
DNSARPSGA

SEQ ID NO: 7172 - protein, 12 aa, Brucella spp.
APKEGGNLTEEQ

SEQ ID NO: 7173 - protein, 14 aa, Brucella spp.
LEEGYTGASGAGRP

SEQ ID NO: 7174 - protein, 5 aa, Brucella spp.
GYSPQ

SEQ ID NO: 7175 - protein, 7 aa, Brucella spp.
KNGAARD

SEQ ID NO: 7176 - protein, 12 aa, Brucella spp.
GDNTYANYAEAN

SEQ ID NO: 7177 - protein, 6 aa, Brucella spp.
LSAERE

SEQ ID NO: 7178 - protein, 21 aa, Brucella spp.
LTDDEKRDAVGYQPRVGRRVS

SEQ ID NO: 7179 - protein, 8 aa, Brucella spp.
AQLPPDGD

SEQ ID NO: 7180 - protein, 12 aa, Brucella spp.
GRGSGKTRAGAE

SEQ ID NO: 7181 - protein, 9 aa, Brucella spp.
PFAGKPSGH

SEQ ID NO: 7182 - protein, 5 aa, Brucella spp.
GPSGI

SEQ ID NO: 7183 - protein, 6 aa, Brucella spp.
PRYEAS

SEQ ID NO: 7184 - protein, 12 aa, Brucella spp.
SSEDPDSLRGPQ

SEQ ID NO: 7185 - protein, 6 aa, Brucella spp.
KNPQET

SEQ ID NO: 7186 - protein, 14 aa, Brucella spp.
GDNPRQVVTTTPRA

SEQ ID NO: 7187 - protein, 9 aa, Brucella spp.
TAENAGNLA

SEQ ID NO: 7188 - protein, 11 aa, Brucella spp.
AGTRLGRQELD

SEQ ID NO: 7189 - protein, 7 aa, Brucella spp.
VEERPGA

SEQ ID NO: 7190 - protein, 6 aa, Brucella spp.
ENPPPL

SEQ ID NO: 7191 - protein, 13 aa, Brucella spp.
DPPASSGKASDAC

SEQ ID NO: 7192 - protein, 5 aa, Brucella spp.
NQGGE

SEQ ID NO: 7193 - protein, 7 aa, Brucella spp.
AEDPSVP

SEQ ID NO: 7194 - protein, 6 aa, Brucella spp.
RASRGK

SEQ ID NO: 7195 - protein, 13 aa, Brucella spp.
PEGLSSGRSPDRL

SEQ ID NO: 7196 - protein, 13 aa, Brucella spp.
TGSEAKAPQRPIE

SEQ ID NO: 7197 - protein, 11 aa, Brucella spp.
EQLPDKSKAEA

SEQ ID NO: 7198 - protein, 23 aa, Brucella spp.
TVDELTAESTTTETGREIATPDI

SEQ ID NO: 7199 - protein, 8 aa, Brucella spp.
AEKRAREI

SEQ ID NO: 7200 - protein, 22 aa, Brucella spp.
LGGGPGVSADIGSARRMADPGA

SEQ ID NO: 7201 - protein, 15 aa, Brucella spp.
DKNAWSRIEASGDPY

SEQ ID NO: 7202 - protein, 13 aa, Brucella spp.
QKTGPISDSDPLV

SEQ ID NO: 7203 - protein, 7 aa, Brucella spp.
APNGDNL

SEQ ID NO: 7204 - protein, 8 aa, Brucella spp.
DNVSNDRK

SEQ ID NO: 7205 - protein, 10 aa, Brucella spp.
RSDASRSDTR

SEQ ID NO: 7206 - protein, 5 aa, Brucella spp.
IGEGA

SEQ ID NO: 7207 - protein, 19 aa, Brucella spp.
SGNRSPSSSKTGSSKADDL

SEQ ID NO: 7208 - protein, 7 aa, Brucella spp.
PGRQDMQ

SEQ ID NO: 7209 - protein, 9 aa, Brucella spp.
STRGKRHAA

SEQ ID NO: 7210 - protein, 4 aa, Brucella spp.
EPVE

SEQ ID NO: 7211 - protein, 6 aa, Brucella spp.
ARRQSD

SEQ ID NO: 7212 - protein, 12 aa, Brucella spp.
DAEPLEKPEIPD

SEQ ID NO: 7213 - protein, 4 aa, Brucella spp.
SGPL

SEQ ID NO: 7214 - protein, 8 aa, Brucella spp.
IETTRDGL

SEQ ID NO: 7215 - protein, 4 aa, Brucella spp.
SDDM

SEQ ID NO: 7216 - protein, 22 aa, Brucella spp.
AENEPLDDAANTDAPKPTRSVK

SEQ ID NO: 7217 - protein, 6 aa, Brucella spp.
VRGGGG

SEQ ID NO: 7218 - protein, 8 aa, Brucella spp.
RRGSPEAG

SEQ ID NO: 7219 - protein, 15 aa, Brucella spp.
SPAPQTSYEEDSDGE

SEQ ID NO: 7220 - protein, 8 aa, Brucella spp.
DMAANTRM

SEQ ID NO: 7221 - protein, 5 aa, Brucella spp.
LTGGA

SEQ ID NO: 7222 - protein, 46 aa, Brucella spp.
PTPRAALPGTAAINSEGKPAAQSVRQPANNGPTPSVATADLSPDRL

SEQ ID NO: 7223 - protein, 4 aa, Brucella spp.
LSGS

SEQ ID NO: 7224 - protein, 5 aa, Brucella spp.
APNAD

SEQ ID NO: 7225 - protein, 13 aa, Brucella spp.
PVDGFTGPQTREA

SEQ ID NO: 7226 - protein, 20 aa, Brucella spp.
VKQASLPAQLENNAPAQDDV

SEQ ID NO: 7227 - protein, 9 aa, Brucella spp.
PSPRPQPAV

SEQ ID NO: 7228 - protein, 36 aa, Brucella spp.
AAPIKPKADLASYEKPAHRKQPAAAAAQPSKISSQD

SEQ ID NO: 7229 - protein, 21 aa, Brucella spp.
AFGNDTVPVNGQPGKATQEAV

SEQ ID NO: 7230 - protein, 27 aa, Brucella spp.
DQENKAQENKPHEKPAHEQAKQEPSSI

SEQ ID NO: 7231 - protein, 6 aa, Brucella spp.
GKTAVE

SEQ ID NO: 7232 - protein, 16 aa, Brucella spp.
CKSGTSLVSSAGSGFL

SEQ ID NO: 7233 - protein, 18 aa, Brucella spp.
GAKKETPVQERPAAAETI

SEQ ID NO: 7234 - protein, 10 aa, Brucella spp.
IPVPTPREEA

SEQ ID NO: 7235 - protein, 6 aa, Brucella spp.
RAQERM

SEQ ID NO: 7236 - protein, 10 aa, Brucella spp.
SKEEKQQASR

SEQ ID NO: 7237 - protein, 8 aa, Brucella spp.
RLKGTNGH

SEQ ID NO: 7238 - protein, 18 aa, Brucella spp.
HAPKHPASDTRHGITRTD

SEQ ID NO: 7239 - protein, 6 aa, Brucella spp.
AENAYQ

SEQ ID NO: 7240 - protein, 5 aa, Brucella spp.
DTENL

SEQ ID NO: 7241 - protein, 18 aa, Brucella spp.
RIKEDDSSVPAKDGPYAY

SEQ ID NO: 7242 - protein, 8 aa, Brucella spp.
YRTGGEQP

SEQ ID NO: 7243 - protein, 9 aa, Brucella spp.
TPRDGGPET

SEQ ID NO: 7244 - protein, 9 aa, Brucella spp.
GDREGEGKA

SEQ ID NO: 7245 - protein, 6 aa, Brucella spp.
ADHAPN

SEQ ID NO: 7246 - protein, 6 aa, Brucella spp.
DKGSEF

SEQ ID NO: 7247 - protein, 13 aa, Brucella spp.
TDTNGGGAWDAKS

SEQ ID NO: 7248 - protein, 6 aa, Brucella spp.
ENHRPS

SEQ ID NO: 7249 - protein, 7 aa, Brucella spp.
GTQQADD

SEQ ID NO: 7250 - protein, 4 aa, Brucella spp.
EETD

SEQ ID NO: 7251 - protein, 4 aa, Brucella spp.
GSAL

SEQ ID NO: 7252 - protein, 8 aa, Brucella spp.
DDPSAEPK

SEQ ID NO: 7253 - protein, 12 aa, Brucella spp.
KAGTEYDIAPGG

SEQ ID NO: 7254 - protein, 6 aa, Brucella spp.
ADGAKD

SEQ ID NO: 7255 - protein, 11 aa, Brucella spp.
APASAPQPENW

SEQ ID NO: 7256 - protein, 5 aa, Brucella spp.
EKPGR

SEQ ID NO: 7257 - protein, 7 aa, Brucella spp.
RKTGEEH

SEQ ID NO: 7258 - protein, 7 aa, Brucella spp.
GSAEYDT

SEQ ID NO: 7259 - protein, 6 aa, Brucella spp.
SMTTPE

SEQ ID NO: 7260 - protein, 4 aa, Brucella spp.
TRER

SEQ ID NO: 7261 - protein, 13 aa, Brucella spp.
TQEVPSGHNPQDY

SEQ ID NO: 7262 - protein, 7 aa, Brucella spp.
TKLDGSA

SEQ ID NO: 7263 - protein, 5 aa, Brucella spp.
SFSTS

SEQ ID NO: 7264 - protein, 7 aa, Brucella spp.
RGGKDKG

SEQ ID NO: 7265 - protein, 11 aa, Brucella spp.
NGKRDKKTNTF

SEQ ID NO: 7266 - protein, 7 aa, Brucella spp.
HGGSAGG

SEQ ID NO: 7267 - protein, 8 aa, Brucella spp.
PLTPPEWP

SEQ ID NO: 7268 - protein, 10 aa, Brucella spp.
NPIASEADYR

SEQ ID NO: 7269 - protein, 13 aa, Brucella spp.
SYSPYDNVTAQAY

SEQ ID NO: 7270 - protein, 4 aa, Brucella spp.
LTDP

SEQ ID NO: 7271 - protein, 6 aa, Brucella spp.
LKTDSH

SEQ ID NO: 7272 - protein, 9 aa, Brucella spp.
GHAGASGRF

SEQ ID NO: 7273 - protein, 12 aa, Brucella spp.
RHADKAGPDGRA

SEQ ID NO: 7274 - protein, 6 aa, Brucella spp.
SVDPAL

SEQ ID NO: 7275 - protein, 7 aa, Brucella spp.
ALKDRGA

SEQ ID NO: 7276 - protein, 6 aa, Brucella spp.
NGSPAM

SEQ ID NO: 7277 - protein, 13 aa, Brucella spp.
TLPPSRSSHQTAG

SEQ ID NO: 7278 - protein, 18 aa, Brucella spp.
GSTVPTSRMNTSSFPRPS

SEQ ID NO: 7279 - protein, 24 aa, Brucella spp.
DTPDIRQNRVAGATRAMEEPARLI

SEQ ID NO: 7280 - protein, 7 aa, Brucella spp.
ATAATGL

SEQ ID NO: 7281 - protein, 18 aa, Brucella spp.
FGNPANRVPQANVDSSYG

SEQ ID NO: 7282 - protein, 6 aa, Brucella spp.
EDNGYQ

SEQ ID NO: 7283 - protein, 8 aa, Brucella spp.
PDPTGEMP

SEQ ID NO: 7284 - protein, 6 aa, Brucella spp.
RWTPPD

SEQ ID NO: 7285 - protein, 16 aa, Brucella spp.
AKNGGMAPGLKNPLGA

SEQ ID NO: 7286 - protein, 8 aa, Brucella spp.
DAATAEKA

SEQ ID NO: 7287 - protein, 8 aa, Brucella spp.
KEGPADKV

SEQ ID NO: 7288 - protein, 14 aa, Brucella spp.
PGAEEAVSQVKGGG

SEQ ID NO: 7289 - protein, 9 aa, Brucella spp.
EKAGDEPVD

SEQ ID NO: 7290 - protein, 13 aa, Brucella spp.
APTDLGERPISPH

SEQ ID NO: 7291 - protein, 8 aa, Brucella spp.
NIAGERSA

SEQ ID NO: 7292 - protein, 13 aa, Brucella spp.
ETAELSVPAPDSD

SEQ ID NO: 7293 - protein, 8 aa, Brucella spp.
LDDGSTRR

SEQ ID NO: 7294 - protein, 11 aa, Brucella spp.
EDEADPSRGKI

SEQ ID NO: 7295 - protein, 4 aa, Brucella spp.
SRHR

SEQ ID NO: 7296 - protein, 6 aa, Brucella spp.
DGDGRN

SEQ ID NO: 7297 - protein, 8 aa, Brucella spp.
ERPTFPRS

SEQ ID NO: 7298 - protein, 7 aa, Brucella spp.
ESGAADA

SEQ ID NO: 7299 - protein, 9 aa, Brucella spp.
SHSGEEEHV

SEQ ID NO: 7300 - protein, 7 aa, Brucella spp.
AGLDSTA

SEQ ID NO: 7301 - protein, 10 aa, Brucella spp.
QSGRQPTPLH

SEQ ID NO: 7302 - protein, 5 aa, Brucella spp.
CSGKH

SEQ ID NO: 7303 - protein, 7 aa, Brucella spp.
VTGAPHS

SEQ ID NO: 7304 - protein, 6 aa, Brucella spp.
GTDGCS

SEQ ID NO: 7305 - protein, 14 aa, Brucella spp.
TGAGLGDKRAKAAQ

SEQ ID NO: 7306 - protein, 4 aa, Brucella spp.
KRAC

SEQ ID NO: 7307 - protein, 9 aa, Brucella spp.
DDGATRASE

SEQ ID NO: 7308 - protein, 5 aa, Brucella spp.
EALSA

SEQ ID NO: 7309 - protein, 7 aa, Brucella spp.
DFASPEM

SEQ ID NO: 7310 - protein, 12 aa, Brucella spp.
TPAAVLGTAQIG

SEQ ID NO: 7311 - protein, 7 aa, Brucella spp.
IGQRGSL

SEQ ID NO: 7312 - protein, 5 aa, Brucella spp.
AGVSP

SEQ ID NO: 7313 - protein, 9 aa, Brucella spp.
KQANTPHER

SEQ ID NO: 7314 - protein, 6 aa, Brucella spp.
QQSDDI

SEQ ID NO: 7315 - protein, 14 aa, Brucella spp.
TSRARANRIAEGAG

SEQ ID NO: 7316 - protein, 9 aa, Brucella spp.
ADAPDAASA

SEQ ID NO: 7317 - protein, 7 aa, Brucella spp.
DKAGKPL

SEQ ID NO: 7318 - protein, 6 aa, Brucella spp.
ATGEEI

SEQ ID NO: 7319 - protein, 5 aa, Brucella spp.
ATPGI

SEQ ID NO: 7320 - protein, 7 aa, Brucella spp.
LKAQGEW

SEQ ID NO: 7321 - protein, 4 aa, Brucella spp.
PVER

SEQ ID NO: 7322 - protein, 8 aa, Brucella spp.
EKNRKLSK

SEQ ID NO: 7323 - protein, 11 aa, Brucella spp.
ETLDTGKALQE

SEQ ID NO: 7324 - protein, 8 aa, Brucella spp.
DAASAADA

SEQ ID NO: 7325 - protein, 5 aa, Brucella spp.
SAPAL

SEQ ID NO: 7326 - protein, 8 aa, Brucella spp.
PSENTPLS

SEQ ID NO: 7327 - protein, 8 aa, Brucella spp.
YKEAGLPD

SEQ ID NO: 7328 - protein, 9 aa, Brucella spp.
LTGSVPTGR

SEQ ID NO: 7329 - protein, 4 aa, Brucella spp.
AGEQ

SEQ ID NO: 7330 - protein, 5 aa, Brucella spp.
LESAI

SEQ ID NO: 7331 - protein, 6 aa, Brucella spp.
QVCSNG

SEQ ID NO: 7332 - protein, 9 aa, Brucella spp.
DPFDEATQM

SEQ ID NO: 7333 - protein, 4 aa, Brucella spp.
AQRD

SEQ ID NO: 7334 - protein, 9 aa, Brucella spp.
KGKAEGATL

SEQ ID NO: 7335 - protein, 9 aa, Brucella spp.
GGGVPKLQG

SEQ ID NO: 7336 - protein, 8 aa, Brucella spp.
RANDSEFG

SEQ ID NO: 7337 - protein, 11 aa, Brucella spp.
YKQSGIGRENG

SEQ ID NO: 7338 - protein, 5 aa, Brucella spp.
AANLA

SEQ ID NO: 7339 - protein, 5 aa, Brucella spp.
SERAL

SEQ ID NO: 7340 - protein, 10 aa, Brucella spp.
DESAARKPDG

SEQ ID NO: 7341 - protein, 6 aa, Brucella spp.
TDPVRE

SEQ ID NO: 7342 - protein, 7 aa, Brucella spp.
LGQSARE

SEQ ID NO: 7343 - protein, 9 aa, Brucella spp.
NGAAGRTAA

SEQ ID NO: 7344 - protein, 6 aa, Brucella spp.
NGTEGS

SEQ ID NO: 7345 - protein, 6 aa, Brucella spp.
RDHRDR

SEQ ID NO: 7346 - protein, 4 aa, Brucella spp.
DFPD

SEQ ID NO: 7347 - protein, 7 aa, Brucella spp.
DKDPQVE

SEQ ID NO: 7348 - protein, 7 aa, Brucella spp.
GAGNSGL

SEQ ID NO: 7349 - protein, 4 aa, Brucella spp.
HKAD

SEQ ID NO: 7350 - protein, 10 aa, Brucella spp.
RDEITSKALE

SEQ ID NO: 7351 - protein, 5 aa, Brucella spp.
AGHEI

SEQ ID NO: 7352 - protein, 11 aa, Brucella spp.
AQNPVGAAHGE

SEQ ID NO: 7353 - protein, 14 aa, Brucella spp.
SRPHPGWSEQDPAQ

SEQ ID NO: 7354 - protein, 6 aa, Brucella spp.
AHPKEF

SEQ ID NO: 7355 - protein, 14 aa, Brucella spp.
RSYREAAELDADPA

SEQ ID NO: 7356 - protein, 11 aa, Brucella spp.
DMSDSAGTSWL

SEQ ID NO: 7357 - protein, 4 aa, Brucella spp.
GARR

SEQ ID NO: 7358 - protein, 9 aa, Brucella spp.
KTGLGEGQM

SEQ ID NO: 7359 - protein, 7 aa, Brucella spp.
EGSEAAG

SEQ ID NO: 7360 - protein, 12 aa, Brucella spp.
GGAGDNAAPACG

SEQ ID NO: 7361 - protein, 4 aa, Brucella spp.
VKPG

SEQ ID NO: 7362 - protein, 10 aa, Brucella spp.
GAYQPKPESA

SEQ ID NO: 7363 - protein, 21 aa, Brucella spp.
GATPQSLDRELGETLKAPGSV

SEQ ID NO: 7364 - protein, 10 aa, Brucella spp.
GERTPYNDAK

SEQ ID NO: 7365 - protein, 7 aa, Brucella spp.
EADRSAL

SEQ ID NO: 7366 - protein, 7 aa, Brucella spp.
SAGTEIT

SEQ ID NO: 7367 - protein, 9 aa, Brucella spp.
AVGGGSRST

SEQ ID NO: 7368 - protein, 7 aa, Brucella spp.
PEEGDFG

SEQ ID NO: 7369 - protein, 5 aa, Brucella spp.
TGADP

SEQ ID NO: 7370 - protein, 13 aa, Brucella spp.
TPPQTARTIEPEQ

SEQ ID NO: 7371 - protein, 10 aa, Brucella spp.
RYEGPESDNP

SEQ ID NO: 7372 - protein, 8 aa, Brucella spp.
GGDPFGGR

SEQ ID NO: 7373 - protein, 12 aa, Brucella spp.
VRPEGRNFAENT

SEQ ID NO: 7374 - protein, 6 aa, Brucella spp.
KQAETG

SEQ ID NO: 7375 - protein, 9 aa, Brucella spp.
GAATNPDPD

SEQ ID NO: 7376 - protein, 6 aa, Brucella spp.
KRLGGE

SEQ ID NO: 7377 - protein, 5 aa, Brucella spp.
REGYE

SEQ ID NO: 7378 - protein, 11 aa, Brucella spp.
PKPQEPTKHQY

SEQ ID NO: 7379 - protein, 18 aa, Brucella spp.
NRNDYQSGWDTDQFPNNV

SEQ ID NO: 7380 - protein, 8 aa, Brucella spp.
FTTGGTNF

SEQ ID NO: 7381 - protein, 7 aa, Brucella spp.
RQSLDPQ

SEQ ID NO: 7382 - protein, 10 aa, Brucella spp.
ALSKPLDERY

SEQ ID NO: 7383 - protein, 29 aa, Brucella spp.
AGEVEAKDINPQPKSGRQEYLENIVNRYV

SEQ ID NO: 7384 - protein, 6 aa, Brucella spp.
EKGYAG

SEQ ID NO: 7385 - protein, 8 aa, Brucella spp.
KASESRDY

SEQ ID NO: 7386 - protein, 8 aa, Brucella spp.
ARENGVEV

SEQ ID NO: 7387 - protein, 10 aa, Brucella spp.
VRGNPQARQQ

SEQ ID NO: 7388 - protein, 4 aa, Brucella spp.
QRPA

SEQ ID NO: 7389 - protein, 4 aa, Brucella spp.
DEHG

SEQ ID NO: 7390 - protein, 4 aa, Brucella spp.
NHKR

SEQ ID NO: 7391 - protein, 13 aa, Brucella spp.
EFNPTGRQGVYGG

SEQ ID NO: 7392 - protein, 8 aa, Brucella spp.
RSLGDGQV

SEQ ID NO: 7393 - protein, 11 aa, Brucella spp.
HPEDGAREGAE

SEQ ID NO: 7394 - protein, 18 aa, Brucella spp.
DFASGGTDEAANRRMLGL

SEQ ID NO: 7395 - protein, 4 aa, Brucella spp.
AEHG

SEQ ID NO: 7396 - protein, 11 aa, Brucella spp.
SAKPEENTRNF

SEQ ID NO: 7397 - protein, 5 aa, Brucella spp.
STGLS

SEQ ID NO: 7398 - protein, 7 aa, Brucella spp.
RPDKPTI

SEQ ID NO: 7399 - protein, 7 aa, Brucella spp.
TSPNYLA

SEQ ID NO: 7400 - protein, 14 aa, Brucella spp.
ESDYSAADATTKAR

SEQ ID NO: 7401 - protein, 5 aa, Brucella spp.
ARTSD

SEQ ID NO: 7402 - protein, 5 aa, Brucella spp.
GPMKP

SEQ ID NO: 7403 - protein, 7 aa, Brucella spp.
LPDTDKT

SEQ ID NO: 7404 - protein, 5 aa, Brucella spp.
GTGTS

SEQ ID NO: 7405 - protein, 8 aa, Brucella spp.
PPQNPEAL

SEQ ID NO: 7406 - protein, 6 aa, Brucella spp.
HDTEQA

SEQ ID NO: 7407 - protein, 7 aa, Brucella spp.
VDAPNSG

SEQ ID NO: 7408 - protein, 16 aa, Brucella spp.
QDGVATDADNRRSRVH

SEQ ID NO: 7409 - protein, 8 aa, Brucella spp.
SLAGQSGK

SEQ ID NO: 7410 - protein, 8 aa, Brucella spp.
EEANPPKL

SEQ ID NO: 7411 - protein, 4 aa, Brucella spp.
DPET

SEQ ID NO: 7412 - protein, 5 aa, Brucella spp.
GKTGA

SEQ ID NO: 7413 - protein, 13 aa, Brucella spp.
KPYPGDKGRVVEP

SEQ ID NO: 7414 - protein, 9 aa, Brucella spp.
DRRQNGDGM

SEQ ID NO: 7415 - protein, 6 aa, Brucella spp.
SKDEER

SEQ ID NO: 7416 - protein, 5 aa, Brucella spp.
PEGGT

SEQ ID NO: 7417 - protein, 8 aa, Brucella spp.
DEPAPAST

SEQ ID NO: 7418 - protein, 7 aa, Brucella spp.
RSQRPKQ

SEQ ID NO: 7419 - protein, 9 aa, Brucella spp.
LSDPNRYSS

SEQ ID NO: 7420 - protein, 6 aa, Brucella spp.
NTAPAI

SEQ ID NO: 7421 - protein, 7 aa, Brucella spp.
ASKDEQT

SEQ ID NO: 7422 - protein, 9 aa, Brucella spp.
ITPTEPATG

SEQ ID NO: 7423 - protein, 8 aa, Brucella spp.
GELEESGA

SEQ ID NO: 7424 - protein, 8 aa, Brucella spp.
EKPKEEVA

SEQ ID NO: 7425 - protein, 11 aa, Brucella spp.
AAEASVATAQR

SEQ ID NO: 7426 - protein, 8 aa, Brucella spp.
EFEKAPDI

SEQ ID NO: 7427 - protein, 15 aa, Brucella spp.
ESKQDPSGNVARGPV

SEQ ID NO: 7428 - protein, 4 aa, Brucella spp.
HNTN

SEQ ID NO: 7429 - protein, 7 aa, Brucella spp.
SEAQGVG

SEQ ID NO: 7430 - protein, 12 aa, Brucella spp.
KQPATAKLAEEH

SEQ ID NO: 7431 - protein, 4 aa, Brucella spp.
GKQL

SEQ ID NO: 7432 - protein, 7 aa, Brucella spp.
NESTYIS

SEQ ID NO: 7433 - protein, 5 aa, Brucella spp.
VSNPG

SEQ ID NO: 7434 - protein, 4 aa, Brucella spp.
AYLG

SEQ ID NO: 7435 - protein, 14 aa, Brucella spp.
PEKPRVQLSSSEGF

SEQ ID NO: 7436 - protein, 5 aa, Brucella spp.
FQGPA

SEQ ID NO: 7437 - protein, 4 aa, Brucella spp.
RNAD

SEQ ID NO: 7438 - protein, 6 aa, Brucella spp.
ATSSAI

SEQ ID NO: 7439 - protein, 4 aa, Brucella spp.
KGWN

SEQ ID NO: 7440 - protein, 5 aa, Brucella spp.
TDSDL

SEQ ID NO: 7441 - protein, 7 aa, Brucella spp.
SSMPEVA

SEQ ID NO: 7442 - protein, 10 aa, Brucella spp.
PSAASVANGT

SEQ ID NO: 7443 - protein, 4 aa, Brucella spp.
IGAG

SEQ ID NO: 7444 - protein, 5 aa, Brucella spp.
GATPV

SEQ ID NO: 7445 - protein, 6 aa, Brucella spp.
QIDPEG

SEQ ID NO: 7446 - protein, 5 aa, Brucella spp.
EGFGT

SEQ ID NO: 7447 - protein, 4 aa, Brucella spp.
HVGT

SEQ ID NO: 7448 - protein, 7 aa, Brucella spp.
TITTGEG

SEQ ID NO: 7449 - protein, 10 aa, Brucella spp.
KSQGTSPTRE

SEQ ID NO: 7450 - protein, 10 aa, Brucella spp.
ARTAASYASK

SEQ ID NO: 7451 - protein, 7 aa, Brucella spp.
SEHREPL

SEQ ID NO: 7452 - protein, 7 aa, Brucella spp.
ENGVDTR

SEQ ID NO: 7453 - protein, 19 aa, Brucella spp.
PHSASTGSYPVADSLSARG

SEQ ID NO: 7454 - protein, 9 aa, Brucella spp.
MSSRSNHSI

SEQ ID NO: 7455 - protein, 9 aa, Brucella spp.
GLTSSGIGA

SEQ ID NO: 7456 - protein, 7 aa, Brucella spp.
DSGSPPL

SEQ ID NO: 7457 - protein, 5 aa, Brucella spp.
QGENI

SEQ ID NO: 7458 - protein, 5 aa, Brucella spp.
RSGWS

SEQ ID NO: 7459 - protein, 7 aa, Brucella spp.
STGLPRS

SEQ ID NO: 7460 - protein, 8 aa, Brucella spp.
EHDKRYTS

SEQ ID NO: 7461 - protein, 6 aa, Brucella spp.
EPARQL

SEQ ID NO: 7462 - protein, 5 aa, Brucella spp.
RSHSD

SEQ ID NO: 7463 - protein, 4 aa, Brucella spp.
AGQL

SEQ ID NO: 7464 - protein, 11 aa, Brucella spp.
EPALEQKERQE

SEQ ID NO: 7465 - protein, 9 aa, Brucella spp.
RSPVPPDTT

SEQ ID NO: 7466 - protein, 7 aa, Brucella spp.
AGGSIGS

SEQ ID NO: 7467 - protein, 5 aa, Brucella spp.
PIRDH

SEQ ID NO: 7468 - protein, 4 aa, Brucella spp.
LNTD

SEQ ID NO: 7469 - protein, 7 aa, Brucella spp.
KAVRPTN

SEQ ID NO: 7470 - protein, 9 aa, Brucella spp.
AEQAGKKKA

SEQ ID NO: 7471 - protein, 5 aa, Brucella spp.
GSNGS

SEQ ID NO: 7472 - protein, 7 aa, Brucella spp.
ANGGPVT

SEQ ID NO: 7473 - protein, 7 aa, Brucella spp.
AIAQSGD

SEQ ID NO: 7474 - protein, 9 aa, Brucella spp.
RNEENPQGD

SEQ ID NO: 7475 - protein, 6 aa, Brucella spp.
IREGEK

SEQ ID NO: 7476 - protein, 6 aa, Brucella spp.
AQRTRH

SEQ ID NO: 7477 - protein, 8 aa, Brucella spp.
RAPQGSKA

SEQ ID NO: 7478 - protein, 7 aa, Brucella spp.
NGTTERY

SEQ ID NO: 7479 - protein, 8 aa, Brucella spp.
EAAGTQTR

SEQ ID NO: 7480 - protein, 10 aa, Brucella spp.
DAGAGPARPR

SEQ ID NO: 7481 - protein, 6 aa, Brucella spp.
RGDQGV

SEQ ID NO: 7482 - protein, 7 aa, Brucella spp.
AGREDNL

SEQ ID NO: 7483 - protein, 11 aa, Brucella spp.
MASKEHGSETV

SEQ ID NO: 7484 - protein, 10 aa, Brucella spp.
KPGGAAAPQV

SEQ ID NO: 7485 - protein, 5 aa, Brucella spp.
AGSLD

SEQ ID NO: 7486 - protein, 15 aa, Brucella spp.
KEIEGGAEAITAEGM

SEQ ID NO: 7487 - protein, 8 aa, Brucella spp.
TARYSTDA

SEQ ID NO: 7488 - protein, 15 aa, Brucella spp.
LNGDMGASLPAETVE

SEQ ID NO: 7489 - protein, 6 aa, Brucella spp.
AGAHDG

SEQ ID NO: 7490 - protein, 12 aa, Brucella spp.
NQPTRSSGEGVA

SEQ ID NO: 7491 - protein, 17 aa, Brucella spp.
AASDRNLLGGKGANLAE

SEQ ID NO: 7492 - protein, 5 aa, Brucella spp.
PVPPG

SEQ ID NO: 7493 - protein, 6 aa, Brucella spp.
RVYPSE

SEQ ID NO: 7494 - protein, 9 aa, Brucella spp.
GRNFGDAEK

SEQ ID NO: 7495 - protein, 8 aa, Brucella spp.
SGARASMP

SEQ ID NO: 7496 - protein, 4 aa, Brucella spp.
DETV

SEQ ID NO: 7497 - protein, 10 aa, Brucella spp.
ARESGDERFA

SEQ ID NO: 7498 - protein, 8 aa, Brucella spp.
DTKADLGV

SEQ ID NO: 7499 - protein, 6 aa, Brucella spp.
ALSADD

SEQ ID NO: 7500 - protein, 16 aa, Brucella spp.
VEEELGQPFPQDPREQ

SEQ ID NO: 7501 - protein, 8 aa, Brucella spp.
GETSATGV

SEQ ID NO: 7502 - protein, 9 aa, Brucella spp.
RNPSTGENK

SEQ ID NO: 7503 - protein, 5 aa, Brucella spp.
QGEDV

SEQ ID NO: 7504 - protein, 9 aa, Brucella spp.
RTPQNITEE

SEQ ID NO: 7505 - protein, 13 aa, Brucella spp.
RIAAGSDKPSLEK

SEQ ID NO: 7506 - protein, 9 aa, Brucella spp.
RSGKRTARA

SEQ ID NO: 7507 - protein, 7 aa, Brucella spp.
IDPRAER

SEQ ID NO: 7508 - protein, 9 aa, Brucella spp.
PASPGAATG

SEQ ID NO: 7509 - protein, 12 aa, Brucella spp.
SEEAEQAKAEGR

SEQ ID NO: 7510 - protein, 6 aa, Brucella spp.
TSPEDI

SEQ ID NO: 7511 - protein, 7 aa, Brucella spp.
TRGGMTS

SEQ ID NO: 7512 - protein, 9 aa, Brucella spp.
KPCVSGAGS

SEQ ID NO: 7513 - protein, 5 aa, Brucella spp.
QTFRK

SEQ ID NO: 7514 - protein, 8 aa, Brucella spp.
DGASGQVL

SEQ ID NO: 7515 - protein, 4 aa, Brucella spp.
LSGD

SEQ ID NO: 7516 - protein, 17 aa, Brucella spp.
ANAETPADARTARSFGA

SEQ ID NO: 7517 - protein, 7 aa, Brucella spp.
DTEEGRR

SEQ ID NO: 7518 - protein, 8 aa, Brucella spp.
TDEEVDEV

SEQ ID NO: 7519 - protein, 7 aa, Brucella spp.
KLRDRAD

SEQ ID NO: 7520 - protein, 10 aa, Brucella spp.
EAGKKTGEPV

SEQ ID NO: 7521 - protein, 4 aa, Brucella spp.
EIAE

SEQ ID NO: 7522 - protein, 6 aa, Brucella spp.
DLTQTT

SEQ ID NO: 7523 - protein, 7 aa, Brucella spp.
ISRDDAA

SEQ ID NO: 7524 - protein, 10 aa, Brucella spp.
AERGRKTREK

SEQ ID NO: 7525 - protein, 8 aa, Brucella spp.
EHGGDPAS

SEQ ID NO: 7526 - protein, 4 aa, Brucella spp.
NTPI

SEQ ID NO: 7527 - protein, 8 aa, Brucella spp.
LSEPADVQ

SEQ ID NO: 7528 - protein, 6 aa, Brucella spp.
DDSLNV

SEQ ID NO: 7529 - protein, 8 aa, Brucella spp.
VPAGGDVK

SEQ ID NO: 7530 - protein, 4 aa, Brucella spp.
TEHS

SEQ ID NO: 7531 - protein, 8 aa, Brucella spp.
EADGETVR

SEQ ID NO: 7532 - protein, 5 aa, Brucella spp.
AAAAG

SEQ ID NO: 7533 - protein, 12 aa, Brucella spp.
RGANAQQHAPEG

SEQ ID NO: 7534 - protein, 6 aa, Brucella spp.
AKPGKL

SEQ ID NO: 7535 - protein, 6 aa, Brucella spp.
KADAPV

SEQ ID NO: 7536 - protein, 6 aa, Brucella spp.
KYIDTG

SEQ ID NO: 7537 - protein, 5 aa, Brucella spp.
DPRAT

SEQ ID NO: 7538 - protein, 9 aa, Brucella spp.
WATAEDGKA

SEQ ID NO: 7539 - protein, 4 aa, Brucella spp.
FTQE

SEQ ID NO: 7540 - protein, 12 aa, Brucella spp.
TVERGSKEFGVN

SEQ ID NO: 7541 - protein, 6 aa, Brucella spp.
KYAGDL

SEQ ID NO: 7542 - protein, 10 aa, Brucella spp.
DAAKGDVADP

SEQ ID NO: 7543 - protein, 7 aa, Brucella spp.
AKASEDD

SEQ ID NO: 7544 - protein, 22 aa, Brucella spp.
GGEFPKSAAGLKELPGIGDYTS

SEQ ID NO: 7545 - protein, 10 aa, Brucella spp.
MTPPDRPGDF

SEQ ID NO: 7546 - protein, 20 aa, Brucella spp.
RDPEDFPVKAPKAEKPVRTG

SEQ ID NO: 7547 - protein, 6 aa, Brucella spp.
RKGEGL

SEQ ID NO: 7548 - protein, 9 aa, Brucella spp.
EVPGSGWTA

SEQ ID NO: 7549 - protein, 11 aa, Brucella spp.
IDGDATVNAAP

SEQ ID NO: 7550 - protein, 6 aa, Brucella spp.
WTPSGT

SEQ ID NO: 7551 - protein, 12 aa, Brucella spp.
SNVRKQAANEGW

SEQ ID NO: 7552 - protein, 4 aa, Brucella spp.
DAGE

SEQ ID NO: 7553 - protein, 10 aa, Brucella spp.
EQDRGRSWQE

SEQ ID NO: 7554 - protein, 6 aa, Brucella spp.
DTFREA

SEQ ID NO: 7555 - protein, 6 aa, Brucella spp.
RGVTVS

SEQ ID NO: 7556 - protein, 9 aa, Brucella spp.
NVEGAKQAG

SEQ ID NO: 7557 - protein, 13 aa, Brucella spp.
KLADDLRARQLSF

SEQ ID NO: 7558 - protein, 8 aa, Brucella spp.
DLHRPDQS

SEQ ID NO: 7559 - protein, 5 aa, Brucella spp.
NPMPN

SEQ ID NO: 7560 - protein, 9 aa, Brucella spp.
RDQKGKGYT

SEQ ID NO: 7561 - protein, 8 aa, Brucella spp.
KAANDDVQ

SEQ ID NO: 7562 - protein, 20 aa, Brucella spp.
SERLKDENGDKVHPTQKPEA

SEQ ID NO: 7563 - protein, 7 aa, Brucella spp.
SSKPGDV

SEQ ID NO: 7564 - protein, 8 aa, Brucella spp.
SGTTGAVA

SEQ ID NO: 7565 - protein, 5 aa, Brucella spp.
EQPYI

SEQ ID NO: 7566 - protein, 5 aa, Brucella spp.
EPLGK

SEQ ID NO: 7567 - protein, 8 aa, Brucella spp.
GKRAEPRV

SEQ ID NO: 7568 - protein, 13 aa, Brucella spp.
DGTLTANGEAGSI

SEQ ID NO: 7569 - protein, 4 aa, Brucella spp.
ASRI

SEQ ID NO: 7570 - protein, 4 aa, Brucella spp.
APLT

SEQ ID NO: 7571 - protein, 4 aa, Brucella spp.
TPRD

SEQ ID NO: 7572 - protein, 4 aa, Brucella spp.
GSGF

SEQ ID NO: 7573 - protein, 4 aa, Brucella spp.
LGST

SEQ ID NO: 7574 - protein, 4 aa, Brucella spp.
SEGR

SEQ ID NO: 7575 - protein, 15 aa, Brucella spp.
AYGDSFDTADKTHSI

SEQ ID NO: 7576 - protein, 7 aa, Brucella spp.
DRAESEA

SEQ ID NO: 7577 - protein, 5 aa, Brucella spp.
NAQDR

SEQ ID NO: 7578 - protein, 14 aa, Brucella spp.
EELDRRRREVAGEV

SEQ ID NO: 7579 - protein, 5 aa, Brucella spp.
EKEAE

SEQ ID NO: 7580 - protein, 12 aa, Brucella spp.
APPKGRNKRSAA

SEQ ID NO: 7581 - protein, 30 aa, Brucella spp.
GCTTSGTENGANSSLPTKATSGEKRISETE

SEQ ID NO: 7582 - protein, 12 aa, Brucella spp.
YEKGGDKDPERV

SEQ ID NO: 7583 - protein, 13 aa, Brucella spp.
TDTTRSCQYGNGT

SEQ ID NO: 7584 - protein, 11 aa, Brucella spp.
GKVVPGPKYKT

SEQ ID NO: 7585 - protein, 9 aa, Brucella spp.
SITNPDTAT

SEQ ID NO: 7586 - protein, 7 aa, Brucella spp.
TIPMPDK

SEQ ID NO: 7587 - protein, 10 aa, Brucella spp.
GARNEAPDRH

SEQ ID NO: 7588 - protein, 7 aa, Brucella spp.
GTENRTA

SEQ ID NO: 7589 - protein, 17 aa, Brucella spp.
ENVGGEINATTSVETTS

SEQ ID NO: 7590 - protein, 10 aa, Brucella spp.
KFDEGELERE

SEQ ID NO: 7591 - protein, 8 aa, Brucella spp.
AAHDTPDD

SEQ ID NO: 7592 - protein, 4 aa, Brucella spp.
GEPE

SEQ ID NO: 7593 - protein, 5 aa, Brucella spp.
GGIDH

SEQ ID NO: 7594 - protein, 8 aa, Brucella spp.
RPHNTAPT

SEQ ID NO: 7595 - protein, 5 aa, Brucella spp.
FRENR

SEQ ID NO: 7596 - protein, 6 aa, Brucella spp.
ATGRDE

SEQ ID NO: 7597 - protein, 5 aa, Brucella spp.
ANSIG

SEQ ID NO: 7598 - protein, 6 aa, Brucella spp.
RARAQY

SEQ ID NO: 7599 - protein, 11 aa, Brucella spp.
QESAASRAGQI

SEQ ID NO: 7600 - protein, 5 aa, Brucella spp.
VENSE

SEQ ID NO: 7601 - protein, 8 aa, Brucella spp.
KPTIAGVG

SEQ ID NO: 7602 - protein, 13 aa, Brucella spp.
ALSTNAHTRTIAV

SEQ ID NO: 7603 - protein, 4 aa, Brucella spp.
SDER

SEQ ID NO: 7604 - protein, 4 aa, Brucella spp.
DEGA

SEQ ID NO: 7605 - protein, 7 aa, Brucella spp.
GGPVDRT

SEQ ID NO: 7606 - protein, 7 aa, Brucella spp.
GGGGPER

SEQ ID NO: 7607 - protein, 4 aa, Brucella spp.
WAPG

SEQ ID NO: 7608 - protein, 5 aa, Brucella spp.
IEGKY

SEQ ID NO: 7609 - protein, 16 aa, Brucella spp.
PAQASTSAWTETPGGR

SEQ ID NO: 7610 - protein, 13 aa, Brucella spp.
GDPAITGKQEVRG

SEQ ID NO: 7611 - protein, 22 aa, Brucella spp.
RNPGDAGVPPQISIEGDAKAQI

SEQ ID NO: 7612 - protein, 10 aa, Brucella spp.
AGDEEGGIGY

SEQ ID NO: 7613 - protein, 7 aa, Brucella spp.
PGGKRLK

SEQ ID NO: 7614 - protein, 13 aa, Brucella spp.
ADRQKSSSENLAA

SEQ ID NO: 7615 - protein, 10 aa, Brucella spp.
LPAPASPDFG

SEQ ID NO: 7616 - protein, 6 aa, Brucella spp.
KHDKDE

SEQ ID NO: 7617 - protein, 7 aa, Brucella spp.
PDPNAPA

SEQ ID NO: 7618 - protein, 12 aa, Brucella spp.
PVSVEDGKASQR

SEQ ID NO: 7619 - protein, 7 aa, Brucella spp.
QGKTKDA

SEQ ID NO: 7620 - protein, 10 aa, Brucella spp.
TADGVTEMTT

SEQ ID NO: 7621 - protein, 7 aa, Brucella spp.
QSTGGEG

SEQ ID NO: 7622 - protein, 7 aa, Brucella spp.
SATFTKA

SEQ ID NO: 7623 - protein, 11 aa, Brucella spp.
SGGGLGVRSKR

SEQ ID NO: 7624 - protein, 20 aa, Brucella spp.
IEEQPGQAVTSAASALLAQL

SEQ ID NO: 7625 - protein, 10 aa, Brucella spp.
CSGNPGPGGW

SEQ ID NO: 7626 - protein, 17 aa, Brucella spp.
GNEKELKGGEAETTNNR

SEQ ID NO: 7627 - protein, 14 aa, Brucella spp.
NGWKTAAKKPVKNA

SEQ ID NO: 7628 - protein, 6 aa, Brucella spp.
EARKAH

SEQ ID NO: 7629 - protein, 14 aa, Brucella spp.
AGHPENERADELAR

SEQ ID NO: 7630 - protein, 7 aa, Brucella spp.
PAAHRNQ

SEQ ID NO: 7631 - protein, 11 aa, Brucella spp.
VPKSVPADAEA

SEQ ID NO: 7632 - protein, 5 aa, Brucella spp.
GHPEV

SEQ ID NO: 7633 - protein, 5 aa, Brucella spp.
QLPDG

SEQ ID NO: 7634 - protein, 7 aa, Brucella spp.
LSVDDTA

SEQ ID NO: 7635 - protein, 6 aa, Brucella spp.
AAPAAE

SEQ ID NO: 7636 - protein, 14 aa, Brucella spp.
TTNRQDAVRAAAPG

SEQ ID NO: 7637 - protein, 9 aa, Brucella spp.
APNSSNSKR

SEQ ID NO: 7638 - protein, 6 aa, Brucella spp.
EKAGAR

SEQ ID NO: 7639 - protein, 8 aa, Brucella spp.
SAGASAPE

SEQ ID NO: 7640 - protein, 6 aa, Brucella spp.
ETTVET

SEQ ID NO: 7641 - protein, 9 aa, Brucella spp.
IKEGHEGHH

SEQ ID NO: 7642 - protein, 4 aa, Brucella spp.
PPKG

SEQ ID NO: 7643 - protein, 6 aa, Brucella spp.
GDFTPK

SEQ ID NO: 7644 - protein, 6 aa, Brucella spp.
SEATAR

SEQ ID NO: 7645 - protein, 6 aa, Brucella spp.
AGASGA

SEQ ID NO: 7646 - protein, 8 aa, Brucella spp.
TRKRPIPA

SEQ ID NO: 7647 - protein, 5 aa, Brucella spp.
STPQN

SEQ ID NO: 7648 - protein, 4 aa, Brucella spp.
GAFP

SEQ ID NO: 7649 - protein, 4 aa, Brucella spp.
TGEI

SEQ ID NO: 7650 - protein, 5 aa, Brucella spp.
TNDYE

SEQ ID NO: 7651 - protein, 7 aa, Brucella spp.
GELSTRR

SEQ ID NO: 7652 - protein, 6 aa, Brucella spp.
DSQPQM

SEQ ID NO: 7653 - protein, 7 aa, Brucella spp.
HDDHKPH

SEQ ID NO: 7654 - protein, 4 aa, Brucella spp.
HKDI

SEQ ID NO: 7655 - protein, 4 aa, Brucella spp.
LQEP

SEQ ID NO: 7656 - protein, 8 aa, Brucella spp.
GDAALDAG

SEQ ID NO: 7657 - protein, 11 aa, Brucella spp.
GPAGGWGPGGG

SEQ ID NO: 7658 - protein, 11 aa, Brucella spp.
FSTSGQPGPAV

SEQ ID NO: 7659 - protein, 8 aa, Brucella spp.
APDGGGDP

SEQ ID NO: 7660 - protein, 16 aa, Brucella spp.
KKREAGANPWGDGATT

SEQ ID NO: 7661 - protein, 16 aa, Brucella spp.
SSPPPFHQWEQLPRIK

SEQ ID NO: 7662 - protein, 8 aa, Brucella spp.
ALADQPRP

SEQ ID NO: 7663 - protein, 5 aa, Brucella spp.
ATGIA

SEQ ID NO: 7664 - protein, 12 aa, Brucella spp.
VNPEPSKTSHNT

SEQ ID NO: 7665 - protein, 10 aa, Brucella spp.
QYSPEDPTLT

SEQ ID NO: 7666 - protein, 15 aa, Brucella spp.
DDDRAAAGKEDRARY

SEQ ID NO: 7667 - protein, 4 aa, Brucella spp.
VPGR

SEQ ID NO: 7668 - protein, 5 aa, Brucella spp.
KEGLY

SEQ ID NO: 7669 - protein, 5 aa, Brucella spp.
KDQYQ

SEQ ID NO: 7670 - protein, 9 aa, Brucella spp.
ATDLPGANK

SEQ ID NO: 7671 - protein, 17 aa, Brucella spp.
QAEGEGSANDKVAAAGL

SEQ ID NO: 7672 - protein, 6 aa, Brucella spp.
AAGAGL

SEQ ID NO: 7673 - protein, 47 aa, Brucella spp.
ATLPSAAQNNTPGTPGQLPAPQQTPAEPQPTTSATPQQSGALKSQHG

SEQ ID NO: 7674 - protein, 9 aa, Brucella spp.
TPAGAKTEQ

SEQ ID NO: 7675 - protein, 5 aa, Brucella spp.
KRPEL

SEQ ID NO: 7676 - protein, 5 aa, Brucella spp.
ADNKA

SEQ ID NO: 7677 - protein, 6 aa, Brucella spp.
DGKDIG

SEQ ID NO: 7678 - protein, 6 aa, Brucella spp.
LRNGKA

SEQ ID NO: 7679 - protein, 6 aa, Brucella spp.
PEEGVG

SEQ ID NO: 7680 - protein, 4 aa, Brucella spp.
KSTI

SEQ ID NO: 7681 - protein, 10 aa, Brucella spp.
TTRQRRPSEI

SEQ ID NO: 7682 - protein, 5 aa, Brucella spp.
GADQL

SEQ ID NO: 7683 - protein, 5 aa, Brucella spp.
QAKMP

SEQ ID NO: 7684 - protein, 9 aa, Brucella spp.
NRRAEDTAE

SEQ ID NO: 7685 - protein, 4 aa, Brucella spp.
DRSY

SEQ ID NO: 7686 - protein, 7 aa, Brucella spp.
LRRDRRP

SEQ ID NO: 7687 - protein, 15 aa, Brucella spp.
VPATVERKAHGAPEH

SEQ ID NO: 7688 - protein, 5 aa, Brucella spp.
VNGKG

SEQ ID NO: 7689 - protein, 9 aa, Brucella spp.
VERSETQAG

SEQ ID NO: 7690 - protein, 7 aa, Brucella spp.
GLAPASV

SEQ ID NO: 7691 - protein, 13 aa, Brucella spp.
QSQRAEDEEERAA

SEQ ID NO: 7692 - protein, 9 aa, Brucella spp.
AEARRQEGK

SEQ ID NO: 7693 - protein, 14 aa, Brucella spp.
ADARNDPSRATEAI

SEQ ID NO: 7694 - protein, 6 aa, Brucella spp.
RELDET

SEQ ID NO: 7695 - protein, 6 aa, Brucella spp.
ADIQEE

SEQ ID NO: 7696 - protein, 9 aa, Brucella spp.
LGEGGPVGR

SEQ ID NO: 7697 - protein, 6 aa, Brucella spp.
NREANT

SEQ ID NO: 7698 - protein, 10 aa, Brucella spp.
LCSKSNAASI

SEQ ID NO: 7699 - protein, 6 aa, Brucella spp.
AAPIAP

SEQ ID NO: 7700 - protein, 72 aa, Brucella spp.
RQQDRGDGVNSEEKPGTNPAEQQSVSEPQNEAVPTAPEKAAEPKPFVPKSASEALRPEPGTPPPRNRSRHAR

SEQ ID NO: 7701 - protein, 8 aa, Brucella spp.
AQGPLTAE

SEQ ID NO: 7702 - protein, 15 aa, Brucella spp.
AGIAEVSNGLESRDI

SEQ ID NO: 7703 - protein, 10 aa, Brucella spp.
HENDLKAGEY

SEQ ID NO: 7704 - protein, 8 aa, Brucella spp.
KEMPPEGS

SEQ ID NO: 7705 - protein, 8 aa, Brucella spp.
TRGTTRSE

SEQ ID NO: 7706 - protein, 8 aa, Brucella spp.
RPDLPVRD

SEQ ID NO: 7707 - protein, 11 aa, Brucella spp.
KETGIASERPH

SEQ ID NO: 7708 - protein, 6 aa, Brucella spp.
RLQSDP

SEQ ID NO: 7709 - protein, 10 aa, Brucella spp.
GAGKPSDRPI

SEQ ID NO: 7710 - protein, 8 aa, Brucella spp.
IEKPTPYN

SEQ ID NO: 7711 - protein, 13 aa, Brucella spp.
PPTPIANPGKAAL

SEQ ID NO: 7712 - protein, 6 aa, Brucella spp.
ANPLQT

SEQ ID NO: 7713 - protein, 5 aa, Brucella spp.
GTGGH

SEQ ID NO: 7714 - protein, 7 aa, Brucella spp.
KGHNDNV

SEQ ID NO: 7715 - protein, 25 aa, Brucella spp.
AAEQQKNIGQQKDTSGGSGKPDTGQ

SEQ ID NO: 7716 - protein, 6 aa, Brucella spp.
DISQQQ

SEQ ID NO: 7717 - protein, 9 aa, Brucella spp.
EANGGKFGK

SEQ ID NO: 7718 - protein, 5 aa, Brucella spp.
NRKAY

SEQ ID NO: 7719 - protein, 5 aa, Brucella spp.
APAAA

SEQ ID NO: 7720 - protein, 8 aa, Brucella spp.
EHEEGQSA

SEQ ID NO: 7721 - protein, 43 aa, Brucella spp.
RRDDRRERDGDDRPRRREGGFDRGDRGDRGPRRPRDNEAGEGA

SEQ ID NO: 7722 - protein, 5 aa, Brucella spp.
QMGDT

SEQ ID NO: 7723 - protein, 5 aa, Brucella spp.
VKDGY

SEQ ID NO: 7724 - protein, 40 aa, Brucella spp.
ALRANEANKKKFEGQRAQLEAQNLERKNEAQAVADKLNGE

SEQ ID NO: 7725 - protein, 7 aa, Brucella spp.
AGETGQL

SEQ ID NO: 7726 - protein, 6 aa, Brucella spp.
SVSTRD

SEQ ID NO: 7727 - protein, 17 aa, Brucella spp.
RSTEEAECQAKGEDLTS

SEQ ID NO: 7728 - protein, 6 aa, Brucella spp.
EQPLSE

SEQ ID NO: 7729 - protein, 21 aa, Brucella spp.
DLTVTDADGSKTRFGDRTGTP

SEQ ID NO: 7730 - protein, 9 aa, Brucella spp.
NTGPTVATE

SEQ ID NO: 7731 - protein, 11 aa, Brucella spp.
ISRSSSNIKSH

SEQ ID NO: 7732 - protein, 4 aa, Brucella spp.
DKQY

SEQ ID NO: 7733 - protein, 11 aa, Brucella spp.
DPPNATLAEAQ

SEQ ID NO: 7734 - protein, 6 aa, Brucella spp.
LSEEQH

SEQ ID NO: 7735 - protein, 13 aa, Brucella spp.
ANQRARDEGLADR

SEQ ID NO: 7736 - protein, 10 aa, Brucella spp.
RSDGPGATNP

SEQ ID NO: 7737 - protein, 9 aa, Brucella spp.
NRDKAKALY

SEQ ID NO: 7738 - protein, 6 aa, Brucella spp.
EAEEKR

SEQ ID NO: 7739 - protein, 23 aa, Brucella spp.
KRLDSAPKGANSETRSVKKSINA

SEQ ID NO: 7740 - protein, 12 aa, Brucella spp.
ARDQKDVRYREA

SEQ ID NO: 7741 - protein, 5 aa, Brucella spp.
PHNIE

SEQ ID NO: 7742 - protein, 7 aa, Brucella spp.
PTEGKVG

SEQ ID NO: 7743 - protein, 4 aa, Brucella spp.
DYGR

SEQ ID NO: 7744 - protein, 10 aa, Brucella spp.
APQEQIEDAE

SEQ ID NO: 7745 - protein, 6 aa, Brucella spp.
ETGRYD

SEQ ID NO: 7746 - protein, 7 aa, Brucella spp.
KMGGLQP

SEQ ID NO: 7747 - protein, 10 aa, Brucella spp.
RPGMGKTSLA

SEQ ID NO: 7748 - protein, 18 aa, Brucella spp.
AYEPDQQADGTIKAANGG

SEQ ID NO: 7749 - protein, 19 aa, Brucella spp.
EQTEVSSSKIRRGEITETD

SEQ ID NO: 7750 - protein, 9 aa, Brucella spp.
RARRLKRQR

SEQ ID NO: 7751 - protein, 12 aa, Brucella spp.
GSSKASAQNRVQ

SEQ ID NO: 7752 - protein, 25 aa, Brucella spp.
RQVESRDDKRPQLSDLRESGSIEQD

SEQ ID NO: 7753 - protein, 11 aa, Brucella spp.
EPRDKFDPKYE

SEQ ID NO: 7754 - protein, 4 aa, Brucella spp.
VRGT

SEQ ID NO: 7755 - protein, 7 aa, Brucella spp.
RHGPTGT

SEQ ID NO: 7756 - protein, 4 aa, Brucella spp.
DSCG

SEQ ID NO: 7757 - protein, 15 aa, Brucella spp.
EEGTNSGIGSGPGAM

SEQ ID NO: 7758 - protein, 8 aa, Brucella spp.
SKRKGRAV

SEQ ID NO: 7759 - protein, 8 aa, Brucella spp.
SGEIEDAP

SEQ ID NO: 7760 - protein, 8 aa, Brucella spp.
DRVTGGGF

SEQ ID NO: 7761 - protein, 8 aa, Brucella spp.
GDPGIGKS

SEQ ID NO: 7762 - protein, 7 aa, Brucella spp.
AALSNRG

SEQ ID NO: 7763 - protein, 5 aa, Brucella spp.
AETNV

SEQ ID NO: 7764 - protein, 11 aa, Brucella spp.
SSDNSGSKRPD

SEQ ID NO: 7765 - protein, 14 aa, Brucella spp.
DSAPGTVTQVRSSA

SEQ ID NO: 7766 - protein, 5 aa, Brucella spp.
KQTGA

SEQ ID NO: 7767 - protein, 8 aa, Brucella spp.
KDGQIAGP

SEQ ID NO: 7768 - protein, 4 aa, Brucella spp.
EGGH

SEQ ID NO: 7769 - protein, 8 aa, Brucella spp.
NRFGPTDE

SEQ ID NO: 7770 - protein, 11 aa, Brucella spp.
DGGLREVSNPS

SEQ ID NO: 7771 - protein, 9 aa, Brucella spp.
RNEKSPGAA

SEQ ID NO: 7772 - protein, 4 aa, Brucella spp.
EGTR

SEQ ID NO: 7773 - protein, 9 aa, Brucella spp.
PSSLGTPRR

SEQ ID NO: 7774 - protein, 9 aa, Brucella spp.
YRISEPAAD

SEQ ID NO: 7775 - protein, 4 aa, Brucella spp.
AEKL

SEQ ID NO: 7776 - protein, 10 aa, Brucella spp.
AEVPNGSGEL

SEQ ID NO: 7777 - protein, 16 aa, Brucella spp.
TNQPDWVTNAKSKPML

SEQ ID NO: 7778 - protein, 8 aa, Brucella spp.
PADPDKSL

SEQ ID NO: 7779 - protein, 25 aa, Brucella spp.
KPKADAPAAGEPEEAPVPDDTPAQE

SEQ ID NO: 7780 - protein, 10 aa, Brucella spp.
MTSHSSENAP

SEQ ID NO: 7781 - protein, 4 aa, Brucella spp.
DAAA

SEQ ID NO: 7782 - protein, 7 aa, Brucella spp.
HRGQEAA

SEQ ID NO: 7783 - protein, 7 aa, Brucella spp.
NRLPGNR

SEQ ID NO: 7784 - protein, 7 aa, Brucella spp.
YSTTGET

SEQ ID NO: 7785 - protein, 6 aa, Brucella spp.
GNFTNG

SEQ ID NO: 7786 - protein, 5 aa, Brucella spp.
ATSDT

SEQ ID NO: 7787 - protein, 9 aa, Brucella spp.
SRHSSSTDR

SEQ ID NO: 7788 - protein, 4 aa, Brucella spp.
DVEN

SEQ ID NO: 7789 - protein, 18 aa, Brucella spp.
KDGSITTRSIKPENPQPE

SEQ ID NO: 7790 - protein, 6 aa, Brucella spp.
DSVVGG

SEQ ID NO: 7791 - protein, 5 aa, Brucella spp.
EAGVD

SEQ ID NO: 7792 - protein, 10 aa, Brucella spp.
VPDGGTPAAL

SEQ ID NO: 7793 - protein, 5 aa, Brucella spp.
HSANR

SEQ ID NO: 7794 - protein, 6 aa, Brucella spp.
VRGTTS

SEQ ID NO: 7795 - protein, 5 aa, Brucella spp.
AGATE

SEQ ID NO: 7796 - protein, 5 aa, Brucella spp.
DTPHA

SEQ ID NO: 7797 - protein, 6 aa, Brucella spp.
NQHESL

SEQ ID NO: 7798 - protein, 14 aa, Brucella spp.
VGGKPRDPKAPTFT

SEQ ID NO: 7799 - protein, 18 aa, Brucella spp.
DQEGESNVHTLSLLASNG

SEQ ID NO: 7800 - protein, 5 aa, Brucella spp.
GASRG

SEQ ID NO: 7801 - protein, 8 aa, Brucella spp.
RKLGSSAT

SEQ ID NO: 7802 - protein, 6 aa, Brucella spp.
ASDAGR

SEQ ID NO: 7803 - protein, 6 aa, Brucella spp.
AASKAA

SEQ ID NO: 7804 - protein, 5 aa, Brucella spp.
EETKK

SEQ ID NO: 7805 - protein, 10 aa, Brucella spp.
SVNPGATRTA

SEQ ID NO: 7806 - protein, 17 aa, Brucella spp.
AMPGEDPETLPTPQSVA

SEQ ID NO: 7807 - protein, 5 aa, Brucella spp.
PKLEV

SEQ ID NO: 7808 - protein, 12 aa, Brucella spp.
GRVDASRGPKLS

SEQ ID NO: 7809 - protein, 7 aa, Brucella spp.
SSKFGAQ

SEQ ID NO: 7810 - protein, 6 aa, Brucella spp.
PNRPAW

SEQ ID NO: 7811 - protein, 5 aa, Brucella spp.
PAPAG

SEQ ID NO: 7812 - protein, 9 aa, Brucella spp.
YNGKSAGSL

SEQ ID NO: 7813 - protein, 19 aa, Brucella spp.
KREAADRKKAAEEASSGDN

SEQ ID NO: 7814 - protein, 6 aa, Brucella spp.
ERVTPM

SEQ ID NO: 7815 - protein, 6 aa, Brucella spp.
SPADGK

SEQ ID NO: 7816 - protein, 4 aa, Brucella spp.
PPAE

SEQ ID NO: 7817 - protein, 7 aa, Brucella spp.
RSPVRGK

SEQ ID NO: 7818 - protein, 10 aa, Brucella spp.
DKASTENERN

SEQ ID NO: 7819 - protein, 4 aa, Brucella spp.
SPHG

SEQ ID NO: 7820 - protein, 8 aa, Brucella spp.
QDDELSVG

SEQ ID NO: 7821 - protein, 6 aa, Brucella spp.
TAIAGE

SEQ ID NO: 7822 - protein, 13 aa, Brucella spp.
YGTERGEPVVRIA

SEQ ID NO: 7823 - protein, 42 aa, Brucella spp.
RTADAPKVDNASIASPVTPGPAKEKPAQAQQTPATAMPATAK

SEQ ID NO: 7824 - protein, 8 aa, Brucella spp.
QAAPNSAV

SEQ ID NO: 7825 - protein, 10 aa, Brucella spp.
GQARAGANGD

SEQ ID NO: 7826 - protein, 6 aa, Brucella spp.
LSPGDH

SEQ ID NO: 7827 - protein, 14 aa, Brucella spp.
ATSSDKHVATSAQT

SEQ ID NO: 7828 - protein, 7 aa, Brucella spp.
PATADGP

SEQ ID NO: 7829 - protein, 9 aa, Brucella spp.
EEPGQASRL

SEQ ID NO: 7830 - protein, 39 aa, Brucella spp.
TKPKTAPEGSAAGAPSGGEMQAGAAGETEQAKPDADRPI

SEQ ID NO: 7831 - protein, 8 aa, Brucella spp.
GKAKDGAR

SEQ ID NO: 7832 - protein, 7 aa, Brucella spp.
SAISPEG

SEQ ID NO: 7833 - protein, 8 aa, Brucella spp.
REAGENIS

SEQ ID NO: 7834 - protein, 28 aa, Brucella spp.
VAPAANQQAGSANTQADGAQDTAALQKV

SEQ ID NO: 7835 - protein, 9 aa, Brucella spp.
RTYGEGTRY

SEQ ID NO: 7836 - protein, 5 aa, Brucella spp.
DQIRN

SEQ ID NO: 7837 - protein, 16 aa, Brucella spp.
PLRDNEVKRKLLEKNP

SEQ ID NO: 7838 - protein, 8 aa, Brucella spp.
SIGQNPLY

SEQ ID NO: 7839 - protein, 6 aa, Brucella spp.
GGTRGI

SEQ ID NO: 7840 - protein, 7 aa, Brucella spp.
EAGGEVT

SEQ ID NO: 7841 - protein, 7 aa, Brucella spp.
ASFERAK

SEQ ID NO: 7842 - protein, 4 aa, Brucella spp.
GIGT

SEQ ID NO: 7843 - protein, 15 aa, Brucella spp.
NGRRKAGDLEIIGKM

SEQ ID NO: 7844 - protein, 13 aa, Brucella spp.
GAGGDGVANLPDG

SEQ ID NO: 7845 - protein, 7 aa, Brucella spp.
ARDKNRA

SEQ ID NO: 7846 - protein, 9 aa, Brucella spp.
ASPERQNPA

SEQ ID NO: 7847 - protein, 8 aa, Brucella spp.
KGRGTDVE

SEQ ID NO: 7848 - protein, 4 aa, Brucella spp.
PHTR

SEQ ID NO: 7849 - protein, 6 aa, Brucella spp.
RKTEKG

SEQ ID NO: 7850 - protein, 7 aa, Brucella spp.
APGSGPF

SEQ ID NO: 7851 - protein, 5 aa, Brucella spp.
LTESG

SEQ ID NO: 7852 - protein, 14 aa, Brucella spp.
ASGCGKLNDEQRRA

SEQ ID NO: 7853 - protein, 6 aa, Brucella spp.
AEAEET

SEQ ID NO: 7854 - protein, 8 aa, Brucella spp.
AVENDAAA

SEQ ID NO: 7855 - protein, 10 aa, Brucella spp.
PPRAGAEEQA

SEQ ID NO: 7856 - protein, 13 aa, Brucella spp.
TRSRARDAIQRGT

SEQ ID NO: 7857 - protein, 10 aa, Brucella spp.
VDGRPITKPG

SEQ ID NO: 7858 - protein, 9 aa, Brucella spp.
VDDPASAYV

SEQ ID NO: 7859 - protein, 5 aa, Brucella spp.
GRTAL

SEQ ID NO: 7860 - protein, 8 aa, Brucella spp.
IGASTGGF

SEQ ID NO: 7861 - protein, 14 aa, Brucella spp.
HDPRVTSKEGVNAR

SEQ ID NO: 7862 - protein, 8 aa, Brucella spp.
REAIGKGG

SEQ ID NO: 7863 - protein, 8 aa, Brucella spp.
DPAYGERM

SEQ ID NO: 7864 - protein, 4 aa, Brucella spp.
TQPG

SEQ ID NO: 7865 - protein, 20 aa, Brucella spp.
SPIEGGDGNREYLLAGKKDR

SEQ ID NO: 7866 - protein, 7 aa, Brucella spp.
APTPDRL

SEQ ID NO: 7867 - protein, 8 aa, Brucella spp.
LPEQDLPQ

SEQ ID NO: 7868 - protein, 7 aa, Brucella spp.
STTGGHL

SEQ ID NO: 7869 - protein, 4 aa, Brucella spp.
GRRD

SEQ ID NO: 7870 - protein, 30 aa, Brucella spp.
AGGLSGFTKRAESEYDPFGAAHSSTSISAG

SEQ ID NO: 7871 - protein, 8 aa, Brucella spp.
SELSGEKR

SEQ ID NO: 7872 - protein, 5 aa, Brucella spp.
GSMSA

SEQ ID NO: 7873 - protein, 5 aa, Brucella spp.
NAGAL

SEQ ID NO: 7874 - protein, 9 aa, Brucella spp.
SIAPPTGAM

SEQ ID NO: 7875 - protein, 16 aa, Brucella spp.
GRTYRSVREAAKQVAQ

SEQ ID NO: 7876 - protein, 9 aa, Brucella spp.
DKARKSEEY

SEQ ID NO: 7877 - protein, 8 aa, Brucella spp.
VRDTQKGP

SEQ ID NO: 7878 - protein, 17 aa, Brucella spp.
KGKGYAPAEAAADKYHG

SEQ ID NO: 7879 - protein, 14 aa, Brucella spp.
GKQAKPPANAPSYT

SEQ ID NO: 7880 - protein, 6 aa, Brucella spp.
EARHDD

SEQ ID NO: 7881 - protein, 6 aa, Brucella spp.
MPTGTG

SEQ ID NO: 7882 - protein, 7 aa, Brucella spp.
LASEGYK

SEQ ID NO: 7883 - protein, 11 aa, Brucella spp.
GADGPTHAGSF

SEQ ID NO: 7884 - protein, 5 aa, Brucella spp.
SDEAE

SEQ ID NO: 7885 - protein, 7 aa, Brucella spp.
AEYDEGP

SEQ ID NO: 7886 - protein, 6 aa, Brucella spp.
PRGDGV

SEQ ID NO: 7887 - protein, 6 aa, Brucella spp.
DLPERG

SEQ ID NO: 7888 - protein, 5 aa, Brucella spp.
IVREG

SEQ ID NO: 7889 - protein, 12 aa, Brucella spp.
EELGAAGLSTTV

SEQ ID NO: 7890 - protein, 5 aa, Brucella spp.
AVGGF

SEQ ID NO: 7891 - protein, 8 aa, Brucella spp.
DHGKPDAM

SEQ ID NO: 7892 - protein, 5 aa, Brucella spp.
GLDRT

SEQ ID NO: 7893 - protein, 9 aa, Brucella spp.
LGDKTSVDS

SEQ ID NO: 7894 - protein, 6 aa, Brucella spp.
TSDIGG

SEQ ID NO: 7895 - protein, 5 aa, Brucella spp.
LPTAR

SEQ ID NO: 7896 - protein, 15 aa, Brucella spp.
SERSPEEERAGPMPV

SEQ ID NO: 7897 - protein, 8 aa, Brucella spp.
IPPTTEER

SEQ ID NO: 7898 - protein, 6 aa, Brucella spp.
QAGPKG

SEQ ID NO: 7899 - protein, 5 aa, Brucella spp.
APLGS

SEQ ID NO: 7900 - protein, 14 aa, Brucella spp.
SKERIEQAKEEWRT

SEQ ID NO: 7901 - protein, 12 aa, Brucella spp.
PGDEQDFIPLPE

SEQ ID NO: 7902 - protein, 7 aa, Brucella spp.
PIPGGSL

SEQ ID NO: 7903 - protein, 25 aa, Brucella spp.
KGNSDDAPATQAQPVPEQPQAGGGL

SEQ ID NO: 7904 - protein, 19 aa, Brucella spp.
SAAAGNASAAPAPGPLGGG

SEQ ID NO: 7905 - protein, 7 aa, Brucella spp.
QSGLGDK

SEQ ID NO: 7906 - protein, 23 aa, Brucella spp.
VGQGENHPIEPGQLGNAIGQTTL

SEQ ID NO: 7907 - protein, 4 aa, Brucella spp.
GIDQ

SEQ ID NO: 7908 - protein, 19 aa, Brucella spp.
TANGQVPDANTLSKLLQGR

SEQ ID NO: 7909 - protein, 9 aa, Brucella spp.
GAPLPGESA

SEQ ID NO: 7910 - protein, 5 aa, Brucella spp.
GDSTG

SEQ ID NO: 7911 - protein, 4 aa, Brucella spp.
PERL

SEQ ID NO: 7912 - protein, 7 aa, Brucella spp.
ERGDVPL

SEQ ID NO: 7913 - protein, 7 aa, Brucella spp.
SAEDKVE

SEQ ID NO: 7914 - protein, 16 aa, Brucella spp.
IGRDGQPVGTEPLDPE

SEQ ID NO: 7915 - protein, 11 aa, Brucella spp.
TPPGHPERPDR

SEQ ID NO: 7916 - protein, 7 aa, Brucella spp.
EAPHAGE

SEQ ID NO: 7917 - protein, 15 aa, Brucella spp.
KIPEPVEDGEASQPI

SEQ ID NO: 7918 - protein, 11 aa, Brucella spp.
GDTYVSPKSMD

SEQ ID NO: 7919 - protein, 5 aa, Brucella spp.
MSGAA

SEQ ID NO: 7920 - protein, 12 aa, Brucella spp.
SRPPGHHAERSR

SEQ ID NO: 7921 - protein, 8 aa, Brucella spp.
HGNGTQDI

SEQ ID NO: 7922 - protein, 13 aa, Brucella spp.
YPGSGDKHETGVG

SEQ ID NO: 7923 - protein, 11 aa, Brucella spp.
PLSPNTGSREF

SEQ ID NO: 7924 - protein, 17 aa, Brucella spp.
EGLSQSASVHITRLLKG

SEQ ID NO: 7925 - protein, 4 aa, Brucella spp.
PPGI

SEQ ID NO: 7926 - protein, 18 aa, Brucella spp.
KRKPGQSKYTTQRREPDQ

SEQ ID NO: 7927 - protein, 9 aa, Brucella spp.
VTMTTTGTP

SEQ ID NO: 7928 - protein, 11 aa, Brucella spp.
TDQRSKDYGEI

SEQ ID NO: 7929 - protein, 8 aa, Brucella spp.
QYRPGHAD

SEQ ID NO: 7930 - protein, 17 aa, Brucella spp.
DYRGGGRSSARETAARV

SEQ ID NO: 7931 - protein, 9 aa, Brucella spp.
PFFTPDAGS

SEQ ID NO: 7932 - protein, 9 aa, Brucella spp.
IRKNGSSVG

SEQ ID NO: 7933 - protein, 8 aa, Brucella spp.
VPAGIGAP

SEQ ID NO: 7934 - protein, 4 aa, Brucella spp.
IGNG

SEQ ID NO: 7935 - protein, 19 aa, Brucella spp.
RLTGEENADEMRMGNDGKP

SEQ ID NO: 7936 - protein, 5 aa, Brucella spp.
ATGAP

SEQ ID NO: 7937 - protein, 20 aa, Brucella spp.
KPTSSILTPRRSIDKDGNEV

SEQ ID NO: 7938 - protein, 5 aa, Brucella spp.
RGRHD

SEQ ID NO: 7939 - protein, 28 aa, Brucella spp.
EDAEGKITDINKDSETITLDDGETYKLP

SEQ ID NO: 7940 - protein, 4 aa, Brucella spp.
SRME

SEQ ID NO: 7941 - protein, 14 aa, Brucella spp.
AKSAVTDKTAKAIL

SEQ ID NO: 7942 - protein, 12 aa, Brucella spp.
RAAVEAKTERLR

SEQ ID NO: 7943 - protein, 15 aa, Brucella spp.
LASEENKPQVASKRK

SEQ ID NO: 7944 - protein, 9 aa, Brucella spp.
KTAKPEEIK

SEQ ID NO: 7945 - protein, 17 aa, Brucella spp.
KHHPDQNQDDPKAQERF

SEQ ID NO: 7946 - protein, 10 aa, Brucella spp.
DKDKRAQFDR

SEQ ID NO: 7947 - protein, 6 aa, Brucella spp.
IDVEGK

SEQ ID NO: 7948 - protein, 13 aa, Brucella spp.
GGQGFGGAHGDPF

SEQ ID NO: 7949 - protein, 8 aa, Brucella spp.
RQGGGNSH

SEQ ID NO: 7950 - protein, 15 aa, Brucella spp.
GGPGGFQGGGFGGAE

SEQ ID NO: 7951 - protein, 22 aa, Brucella spp.
FGGGRSGARQRGPSKGADLSAS

SEQ ID NO: 7952 - protein, 5 aa, Brucella spp.
AVGAE

SEQ ID NO: 7953 - protein, 6 aa, Brucella spp.
EDGQTI

SEQ ID NO: 7954 - protein, 16 aa, Brucella spp.
LKGQGEPLMGGTPGDA

SEQ ID NO: 7955 - protein, 11 aa, Brucella spp.
LGGKQEVETLD

SEQ ID NO: 7956 - protein, 6 aa, Brucella spp.
AWSSSD

SEQ ID NO: 7957 - protein, 12 aa, Brucella spp.
KGLPLKAGGRGD

SEQ ID NO: 7958 - protein, 17 aa, Brucella spp.
EGGDKELEDFLQKRRVV

SEQ ID NO: 7959 - protein, 11 aa, Brucella spp.
AAKSEPNDPNA

SEQ ID NO: 7960 - protein, 7 aa, Brucella spp.
VDPDGLP

SEQ ID NO: 7961 - protein, 10 aa, Brucella spp.
ESKKGQEILS

SEQ ID NO: 7962 - protein, 24 aa, Brucella spp.
GPVEKVSDAEADAYYASRPRGSRI

SEQ ID NO: 7963 - protein, 10 aa, Brucella spp.
ASKQSRPLES

SEQ ID NO: 7964 - protein, 4 aa, Brucella spp.
AEYT

SEQ ID NO: 7965 - protein, 6 aa, Brucella spp.
IPRPPY

SEQ ID NO: 7966 - protein, 15 aa, Brucella spp.
RPTPEGDWNKDRLYP

SEQ ID NO: 7967 - protein, 4 aa, Brucella spp.
NPGI

SEQ ID NO: 7968 - protein, 4 aa, Brucella spp.
EMRA

SEQ ID NO: 7969 - protein, 15 aa, Brucella spp.
PSRAAAQLEGSKGFT

SEQ ID NO: 7970 - protein, 4 aa, Brucella spp.
TGAY

SEQ ID NO: 7971 - protein, 15 aa, Brucella spp.
FNNAPKAKAYIRQQG

SEQ ID NO: 7972 - protein, 6 aa, Brucella spp.
GLAAGK

SEQ ID NO: 7973 - protein, 4 aa, Brucella spp.
AAGA

SEQ ID NO: 7974 - protein, 34 aa, Brucella spp.
TALPLGSAQDHKRVGDGDTGPNTGGMGAYAPAPV

SEQ ID NO: 7975 - protein, 6 aa, Brucella spp.
SDGPKL

SEQ ID NO: 7976 - protein, 5 aa, Brucella spp.
RFGDP

SEQ ID NO: 7977 - protein, 4 aa, Brucella spp.
DGRL

SEQ ID NO: 7978 - protein, 4 aa, Brucella spp.
KDEP

SEQ ID NO: 7979 - protein, 12 aa, Brucella spp.
GYPANVKKGSVI

SEQ ID NO: 7980 - protein, 6 aa, Brucella spp.
TALKDG

SEQ ID NO: 7981 - protein, 4 aa, Brucella spp.
VASG

SEQ ID NO: 7982 - protein, 12 aa, Brucella spp.
AATVAQAQARAY

SEQ ID NO: 7983 - protein, 10 aa, Brucella spp.
NRPEKKNAIT

SEQ ID NO: 7984 - protein, 10 aa, Brucella spp.
LKDGDADDAV

SEQ ID NO: 7985 - protein, 8 aa, Brucella spp.
AFSSGNDM

SEQ ID NO: 7986 - protein, 9 aa, Brucella spp.
ATGDTSFGS

SEQ ID NO: 7987 - protein, 8 aa, Brucella spp.
TKKPIVSG

SEQ ID NO: 7988 - protein, 6 aa, Brucella spp.
PEAGSS

SEQ ID NO: 7989 - protein, 7 aa, Brucella spp.
AEAAQEA

SEQ ID NO: 7990 - protein, 11 aa, Brucella spp.
EEIAAKPPQAM

SEQ ID NO: 7991 - protein, 5 aa, Brucella spp.
DRITR

SEQ ID NO: 7992 - protein, 18 aa, Brucella spp.
LTSDEAREAVMAFLSRKK

SEQ ID NO: 7993 - protein, 8 aa, Brucella spp.
SPSAAVQL

SEQ ID NO: 7994 - protein, 19 aa, Brucella spp.
GRERPPILPPDEDFDFEQL

SEQ ID NO: 7995 - protein, 9 aa, Brucella spp.
KNALTAPED

SEQ ID NO: 7996 - protein, 7 aa, Brucella spp.
PGSTEEV

SEQ ID NO: 7997 - protein, 27 aa, Brucella spp.
TETRTPVVPQGGNTGLVGGQQPDESGA

SEQ ID NO: 7998 - protein, 8 aa, Brucella spp.
QDAAEKAG

SEQ ID NO: 7999 - protein, 19 aa, Brucella spp.
AEGSCQIGGNLGSNAGGTA

SEQ ID NO: 8000 - protein, 8 aa, Brucella spp.
KKDNTGYD

SEQ ID NO: 8001 - protein, 5 aa, Brucella spp.
SEGTL

SEQ ID NO: 8002 - protein, 9 aa, Brucella spp.
PQPKGKGVA

SEQ ID NO: 8003 - protein, 6 aa, Brucella spp.
LRSPED

SEQ ID NO: 8004 - protein, 8 aa, Brucella spp.
EHAGPSLT

SEQ ID NO: 8005 - protein, 7 aa, Brucella spp.
RDPLESP

SEQ ID NO: 8006 - protein, 12 aa, Brucella spp.
SSRSEEDARTTL

SEQ ID NO: 8007 - protein, 5 aa, Brucella spp.
ESVAQ

SEQ ID NO: 8008 - protein, 10 aa, Brucella spp.
AQKPEGGSIK

SEQ ID NO: 8009 - protein, 8 aa, Brucella spp.
QPVGADKE

SEQ ID NO: 8010 - protein, 11 aa, Brucella spp.
YGGSISAEHGI

SEQ ID NO: 8011 - protein, 18 aa, Brucella spp.
KDVHEDIKGPSVSAPEQA

SEQ ID NO: 8012 - protein, 6 aa, Brucella spp.
GLSDVS

SEQ ID NO: 8013 - protein, 9 aa, Brucella spp.
VHSDPKKGD

SEQ ID NO: 8014 - protein, 9 aa, Brucella spp.
TKPGRAAED

SEQ ID NO: 8015 - protein, 6 aa, Brucella spp.
SARPGA

SEQ ID NO: 8016 - protein, 8 aa, Brucella spp.
GPETEETK

SEQ ID NO: 8017 - protein, 7 aa, Brucella spp.
IKSGNVT

SEQ ID NO: 8018 - protein, 5 aa, Brucella spp.
RRKEI

SEQ ID NO: 8019 - protein, 19 aa, Brucella spp.
RKQGDASRLASPAPQHEEI

SEQ ID NO: 8020 - protein, 13 aa, Brucella spp.
AARDGGTEIAYGN

SEQ ID NO: 8021 - protein, 5 aa, Brucella spp.
HDLPD

SEQ ID NO: 8022 - protein, 8 aa, Brucella spp.
LAASAEKF

SEQ ID NO: 8023 - protein, 6 aa, Brucella spp.
KPLDQR

SEQ ID NO: 8024 - protein, 8 aa, Brucella spp.
LGTQGQRV

SEQ ID NO: 8025 - protein, 8 aa, Brucella spp.
ADPKLAQR

SEQ ID NO: 8026 - protein, 4 aa, Brucella spp.
DLQT

SEQ ID NO: 8027 - protein, 8 aa, Brucella spp.
QGEDKAVA

SEQ ID NO: 8028 - protein, 16 aa, Brucella spp.
HYKPQGPSDVVPKNPV

SEQ ID NO: 8029 - protein, 12 aa, Brucella spp.
EKPTGSKDPYAL

SEQ ID NO: 8030 - protein, 4 aa, Brucella spp.
EGQM

SEQ ID NO: 8031 - protein, 17 aa, Brucella spp.
AAENSGDVDGEQDVDNA

SEQ ID NO: 8032 - protein, 14 aa, Brucella spp.
EKEIRAEAEASCGP

SEQ ID NO: 8033 - protein, 7 aa, Brucella spp.
EEGARYD

SEQ ID NO: 8034 - protein, 4 aa, Brucella spp.
TPEA

SEQ ID NO: 8035 - protein, 7 aa, Brucella spp.
AGAKRAA

SEQ ID NO: 8036 - protein, 13 aa, Brucella spp.
AEEKKGTKVADRV

SEQ ID NO: 8037 - protein, 4 aa, Brucella spp.
AEEK

SEQ ID NO: 8038 - protein, 7 aa, Brucella spp.
SREVGEA

SEQ ID NO: 8039 - protein, 9 aa, Brucella spp.
NDEDGNVRA

SEQ ID NO: 8040 - protein, 14 aa, Brucella spp.
AATGKVADFSKIAG

SEQ ID NO: 8041 - protein, 7 aa, Brucella spp.
AGRAEHA

SEQ ID NO: 8042 - protein, 17 aa, Brucella spp.
RRRGRGAGINPSGRFEP

SEQ ID NO: 8043 - protein, 4 aa, Brucella spp.
IEKP

SEQ ID NO: 8044 - protein, 5 aa, Brucella spp.
NPYRG

SEQ ID NO: 8045 - protein, 7 aa, Brucella spp.
KPDAPRL

SEQ ID NO: 8046 - protein, 9 aa, Brucella spp.
ARPGYQPKT

SEQ ID NO: 8047 - protein, 11 aa, Brucella spp.
IGTNTDPYQPV

SEQ ID NO: 8048 - protein, 10 aa, Brucella spp.
MEPRASTPSL

SEQ ID NO: 8049 - protein, 5 aa, Brucella spp.
DAGIP

SEQ ID NO: 8050 - protein, 8 aa, Brucella spp.
YAQGAREA

SEQ ID NO: 8051 - protein, 10 aa, Brucella spp.
RDGKDYDAEW

SEQ ID NO: 8052 - protein, 7 aa, Brucella spp.
MRGTGPY

SEQ ID NO: 8053 - protein, 7 aa, Brucella spp.
PDFSQEQ

SEQ ID NO: 8054 - protein, 11 aa, Brucella spp.
DEAGRGPLAGP

SEQ ID NO: 8055 - protein, 18 aa, Brucella spp.
NDLPEGLDDSKRLTAARR

SEQ ID NO: 8056 - protein, 11 aa, Brucella spp.
SARSIDASDIR

SEQ ID NO: 8057 - protein, 11 aa, Brucella spp.
RDVPPGLPCPG

SEQ ID NO: 8058 - protein, 9 aa, Brucella spp.
VKGDQRSVS

SEQ ID NO: 8059 - protein, 7 aa, Brucella spp.
AAHPPYG

SEQ ID NO: 8060 - protein, 18 aa, Brucella spp.
YATQKHRAAIESEGPVPG

SEQ ID NO: 8061 - protein, 21 aa, Brucella spp.
DERADRIKKELEEARTLREEA

SEQ ID NO: 8062 - protein, 13 aa, Brucella spp.
RKRKEAEKEAGDI

SEQ ID NO: 8063 - protein, 8 aa, Brucella spp.
ASAEREAK

SEQ ID NO: 8064 - protein, 10 aa, Brucella spp.
EAKRATEEYV

SEQ ID NO: 8065 - protein, 16 aa, Brucella spp.
NKLAEQKIATAETDAI

SEQ ID NO: 8066 - protein, 9 aa, Brucella spp.
VDAKAAGNL

SEQ ID NO: 8067 - protein, 34 aa, Brucella spp.
TESQPASTAGEHGAADAVHTETGVAHDAGHGSGV

SEQ ID NO: 8068 - protein, 5 aa, Brucella spp.
TRRDR

SEQ ID NO: 8069 - protein, 14 aa, Brucella spp.
EQAARLKQDADNAI

SEQ ID NO: 8070 - protein, 32 aa, Brucella spp.
LAQARSKAASIAEAAREKGKGEADAERASAEA

SEQ ID NO: 8071 - protein, 8 aa, Brucella spp.
LKEAEERI

SEQ ID NO: 8072 - protein, 5 aa, Brucella spp.
AMSDV

SEQ ID NO: 8073 - protein, 5 aa, Brucella spp.
NIAEE

SEQ ID NO: 8074 - protein, 18 aa, Brucella spp.
ADKASVSEAVKAIRASNA

SEQ ID NO: 8075 - protein, 6 aa, Brucella spp.
SGRGLI

SEQ ID NO: 8076 - protein, 9 aa, Brucella spp.
LRDSAGSKG

SEQ ID NO: 8077 - protein, 4 aa, Brucella spp.
VGSV

SEQ ID NO: 8078 - protein, 8 aa, Brucella spp.
GSIATNGI

SEQ ID NO: 8079 - protein, 30 aa, Brucella spp.
SGGRKTAKLGVDDPNPDENRINRADKTNRL

SEQ ID NO: 8080 - protein, 11 aa, Brucella spp.
KPKAPAKAFTA

SEQ ID NO: 8081 - protein, 8 aa, Brucella spp.
SRPPEKID

SEQ ID NO: 8082 - protein, 5 aa, Brucella spp.
EGKEI

SEQ ID NO: 8083 - protein, 12 aa, Brucella spp.
KPPKPKAELPTQ

SEQ ID NO: 8084 - protein, 6 aa, Brucella spp.
NNEQPD

SEQ ID NO: 8085 - protein, 14 aa, Brucella spp.
APATPDYGKTSPFE

SEQ ID NO: 8086 - protein, 9 aa, Brucella spp.
RPDQSEGRF

SEQ ID NO: 8087 - protein, 8 aa, Brucella spp.
PIGDQDHD

SEQ ID NO: 8088 - protein, 14 aa, Brucella spp.
ATPLPPSAFSPREQ

SEQ ID NO: 8089 - protein, 9 aa, Brucella spp.
ARGESVKGQ

SEQ ID NO: 8090 - protein, 6 aa, Brucella spp.
NPAYPG

SEQ ID NO: 8091 - protein, 9 aa, Brucella spp.
QKHRVTEPA

SEQ ID NO: 8092 - protein, 6 aa, Brucella spp.
AKTVSA

SEQ ID NO: 8093 - protein, 5 aa, Brucella spp.
NVGKS

SEQ ID NO: 8094 - protein, 8 aa, Brucella spp.
PGVTRDRR

SEQ ID NO: 8095 - protein, 12 aa, Brucella spp.
GLEEAANDSLEA

SEQ ID NO: 8096 - protein, 11 aa, Brucella spp.
RAQTEAAISEA

SEQ ID NO: 8097 - protein, 11 aa, Brucella spp.
AGITPADSTFA

SEQ ID NO: 8098 - protein, 7 aa, Brucella spp.
VRRSGKP

SEQ ID NO: 8099 - protein, 11 aa, Brucella spp.
KAEARGSEAGM

SEQ ID NO: 8100 - protein, 8 aa, Brucella spp.
EHGQGMPD

SEQ ID NO: 8101 - protein, 10 aa, Brucella spp.
EERQEEAADE

SEQ ID NO: 8102 - protein, 19 aa, Brucella spp.
DDIEDPDAEEIPAYDATKP

SEQ ID NO: 8103 - protein, 8 aa, Brucella spp.
RPNAGKST

SEQ ID NO: 8104 - protein, 13 aa, Brucella spp.
LTGPEAGITRDSI

SEQ ID NO: 8105 - protein, 9 aa, Brucella spp.
RRKARVQEK

SEQ ID NO: 8106 - protein, 9 aa, Brucella spp.
ISGERGQGI

SEQ ID NO: 8107 - protein, 4 aa, Brucella spp.
STGR

SEQ ID NO: 8108 - protein, 10 aa, Brucella spp.
HQPPPAVSGR

SEQ ID NO: 8109 - protein, 6 aa, Brucella spp.
KTRPPG

SEQ ID NO: 8110 - protein, 7 aa, Brucella spp.
RPDAMPQ

SEQ ID NO: 8111 - protein, 14 aa, Brucella spp.
TSDNPFAGRAKKKK

SEQ ID NO: 8112 - protein, 8 aa, Brucella spp.
ELRSERAK

SEQ ID NO: 8113 - protein, 10 aa, Brucella spp.
DSKASASGDK

SEQ ID NO: 8114 - protein, 9 aa, Brucella spp.
AAGKTDEAL

SEQ ID NO: 8115 - protein, 8 aa, Brucella spp.
EKTGYGSY

SEQ ID NO: 8116 - protein, 11 aa, Brucella spp.
LADKGDAAAAV

SEQ ID NO: 8117 - protein, 15 aa, Brucella spp.
EISADNSVPEPSRNI

SEQ ID NO: 8118 - protein, 8 aa, Brucella spp.
NGSYDDVA

SEQ ID NO: 8119 - protein, 18 aa, Brucella spp.
VEPLSADGNPMRTSAREA

SEQ ID NO: 8120 - protein, 5 aa, Brucella spp.
ERFDD

SEQ ID NO: 8121 - protein, 11 aa, Brucella spp.
DSLAPANARQR

SEQ ID NO: 8122 - protein, 8 aa, Brucella spp.
NLPNHGKQ

SEQ ID NO: 8123 - protein, 5 aa, Brucella spp.
GTAPA

SEQ ID NO: 8124 - protein, 7 aa, Brucella spp.
PQEAGLS

SEQ ID NO: 8125 - protein, 22 aa, Brucella spp.
ASGLKKSAAVLKDDNPEEANTT

SEQ ID NO: 8126 - protein, 5 aa, Brucella spp.
SRYER

SEQ ID NO: 8127 - protein, 12 aa, Brucella spp.
NALRKKETEPPA

SEQ ID NO: 8128 - protein, 13 aa, Brucella spp.
MEPGREPHRIPPI

SEQ ID NO: 8129 - protein, 7 aa, Brucella spp.
SDQPDSV

SEQ ID NO: 8130 - protein, 9 aa, Brucella spp.
KKEGLDAET

SEQ ID NO: 8131 - protein, 4 aa, Brucella spp.
AGTT

SEQ ID NO: 8132 - protein, 13 aa, Brucella spp.
PEDVRSNVDAASA

SEQ ID NO: 8133 - protein, 5 aa, Brucella spp.
AGAAT

SEQ ID NO: 8134 - protein, 12 aa, Brucella spp.
LSGGSGLAQRVP

SEQ ID NO: 8135 - protein, 8 aa, Brucella spp.
LGNPNGDV

SEQ ID NO: 8136 - protein, 9 aa, Brucella spp.
EKSGNYEKA

SEQ ID NO: 8137 - protein, 22 aa, Brucella spp.
TPGRLTRDQVDGALKKAGLDAA

SEQ ID NO: 8138 - protein, 11 aa, Brucella spp.
QAAYKADAKRI

SEQ ID NO: 8139 - protein, 5 aa, Brucella spp.
MKQGE

SEQ ID NO: 8140 - protein, 14 aa, Brucella spp.
YGLTPKKVDQSTYM

SEQ ID NO: 8141 - protein, 7 aa, Brucella spp.
SREYAEP

SEQ ID NO: 8142 - protein, 6 aa, Brucella spp.
QANRPV

SEQ ID NO: 8143 - protein, 20 aa, Brucella spp.
NEAPMGGTRPVAGATMQPAE

SEQ ID NO: 8144 - protein, 5 aa, Brucella spp.
GMRPY

SEQ ID NO: 8145 - protein, 10 aa, Brucella spp.
GSKRTGPDLA

SEQ ID NO: 8146 - protein, 7 aa, Brucella spp.
VGGRYSN

SEQ ID NO: 8147 - protein, 6 aa, Brucella spp.
RPLKAD

SEQ ID NO: 8148 - protein, 32 aa, Brucella spp.
LKAQATPDADTSGMEERYPKARVGDFDGNPQM

SEQ ID NO: 8149 - protein, 8 aa, Brucella spp.
VSTTGHEW

SEQ ID NO: 8150 - protein, 4 aa, Brucella spp.
LDNP

SEQ ID NO: 8151 - protein, 12 aa, Brucella spp.
GSTAGLTGWSSR

SEQ ID NO: 8152 - protein, 6 aa, Brucella spp.
IAASRQ

SEQ ID NO: 8153 - protein, 14 aa, Brucella spp.
GSGAQGAPGYPNLN

SEQ ID NO: 8154 - protein, 11 aa, Brucella spp.
VRSPDDPETRL

SEQ ID NO: 8155 - protein, 13 aa, Brucella spp.
SGTPHDPSMVPEG

SEQ ID NO: 8156 - protein, 8 aa, Brucella spp.
ADAKGLRE

SEQ ID NO: 8157 - protein, 5 aa, Brucella spp.
GAPNL

SEQ ID NO: 8158 - protein, 4 aa, Brucella spp.
GDAT

SEQ ID NO: 8159 - protein, 11 aa, Brucella spp.
VNSPKTRQSLY

SEQ ID NO: 8160 - protein, 6 aa, Brucella spp.
AYAPDQ

SEQ ID NO: 8161 - protein, 8 aa, Brucella spp.
VEGDRNAR

SEQ ID NO: 8162 - protein, 21 aa, Brucella spp.
WRGEPRSRHSKKAIAAGETVG

SEQ ID NO: 8163 - protein, 6 aa, Brucella spp.
IGKPRG

SEQ ID NO: 8164 - protein, 13 aa, Brucella spp.
NNGIAPTDPARVY

SEQ ID NO: 8165 - protein, 10 aa, Brucella spp.
EAPNKFSDKV

SEQ ID NO: 8166 - protein, 7 aa, Brucella spp.
GSIRNGY

SEQ ID NO: 8167 - protein, 5 aa, Brucella spp.
LPEAT

SEQ ID NO: 8168 - protein, 12 aa, Brucella spp.
VQDETPDANGNY

SEQ ID NO: 8169 - protein, 5 aa, Brucella spp.
EPDKL

SEQ ID NO: 8170 - protein, 9 aa, Brucella spp.
AVTEPRKDY

SEQ ID NO: 8171 - protein, 20 aa, Brucella spp.
AEDGSEGARYKATFMAPERK

SEQ ID NO: 8172 - protein, 16 aa, Brucella spp.
SQEFNDKAKTGKEQAA

SEQ ID NO: 8173 - protein, 7 aa, Brucella spp.
SKPAYEN

SEQ ID NO: 8174 - protein, 6 aa, Brucella spp.
HNGKAV

SEQ ID NO: 8175 - protein, 5 aa, Brucella spp.
AMTGG

SEQ ID NO: 8176 - protein, 10 aa, Brucella spp.
RPVGDAHDTK

SEQ ID NO: 8177 - protein, 5 aa, Brucella spp.
DAGLE

SEQ ID NO: 8178 - protein, 5 aa, Brucella spp.
AADPE

SEQ ID NO: 8179 - protein, 9 aa, Brucella spp.
LPEKPKGRT

SEQ ID NO: 8180 - protein, 11 aa, Brucella spp.
HPVPDGAGLAA

SEQ ID NO: 8181 - protein, 5 aa, Brucella spp.
GLSED

SEQ ID NO: 8182 - protein, 15 aa, Brucella spp.
GGGSALLPSPPEGMT

SEQ ID NO: 8183 - protein, 7 aa, Brucella spp.
ASGAPIS

SEQ ID NO: 8184 - protein, 6 aa, Brucella spp.
TIKGGR

SEQ ID NO: 8185 - protein, 7 aa, Brucella spp.
LAAAAHP

SEQ ID NO: 8186 - protein, 8 aa, Brucella spp.
IPGDNPAF

SEQ ID NO: 8187 - protein, 15 aa, Brucella spp.
ASGPTVPDETSRDEA

SEQ ID NO: 8188 - protein, 13 aa, Brucella spp.
SENAHAPQPDDGV

SEQ ID NO: 8189 - protein, 10 aa, Brucella spp.
AAAREASRHG

SEQ ID NO: 8190 - protein, 8 aa, Brucella spp.
SVEGEARE

SEQ ID NO: 8191 - protein, 9 aa, Brucella spp.
VAERDRPFK

SEQ ID NO: 8192 - protein, 19 aa, Brucella spp.
GGETTVTIGSPGGKGGRNS

SEQ ID NO: 8193 - protein, 24 aa, Brucella spp.
ADTDGIDGSEDNAGAFADGGTVSR

SEQ ID NO: 8194 - protein, 7 aa, Brucella spp.
KLGEDGM

SEQ ID NO: 8195 - protein, 18 aa, Brucella spp.
PGPTGTNVNDLRAILITV

SEQ ID NO: 8196 - protein, 9 aa, Brucella spp.
DEPQSLDDS

SEQ ID NO: 8197 - protein, 11 aa, Brucella spp.
AEVSGEAGADV

SEQ ID NO: 8198 - protein, 6 aa, Brucella spp.
FADEQH

SEQ ID NO: 8199 - protein, 4 aa, Brucella spp.
GTTT

SEQ ID NO: 8200 - protein, 6 aa, Brucella spp.
NAPPAL

SEQ ID NO: 8201 - protein, 10 aa, Brucella spp.
TAQSGYDDTK

SEQ ID NO: 8202 - protein, 10 aa, Brucella spp.
TSTPEQLEAS

SEQ ID NO: 8203 - protein, 5 aa, Brucella spp.
SENHD

SEQ ID NO: 8204 - protein, 6 aa, Brucella spp.
YPDAPD

SEQ ID NO: 8205 - protein, 7 aa, Brucella spp.
DIGGGTS

SEQ ID NO: 8206 - protein, 8 aa, Brucella spp.
TLEEGTEA

SEQ ID NO: 8207 - protein, 7 aa, Brucella spp.
SSATSPM

SEQ ID NO: 8208 - protein, 19 aa, Brucella spp.
RGGVATEQKHDSAHKHVTG

SEQ ID NO: 8209 - protein, 7 aa, Brucella spp.
IPEPEGT

SEQ ID NO: 8210 - protein, 5 aa, Brucella spp.
RAAPG

SEQ ID NO: 8211 - protein, 14 aa, Brucella spp.
DVPGENDVSPSGMH

SEQ ID NO: 8212 - protein, 9 aa, Brucella spp.
TRDQARRAA

SEQ ID NO: 8213 - protein, 6 aa, Brucella spp.
YEEAPG

SEQ ID NO: 8214 - protein, 15 aa, Brucella spp.
ERGNARAAIDAAPHR

SEQ ID NO: 8215 - protein, 8 aa, Brucella spp.
AVPGEDED

SEQ ID NO: 8216 - protein, 9 aa, Brucella spp.
STQGPSETQ

SEQ ID NO: 8217 - protein, 13 aa, Brucella spp.
GGGFGGKETQANQ

SEQ ID NO: 8218 - protein, 6 aa, Brucella spp.
KKHKRA

SEQ ID NO: 8219 - protein, 11 aa, Brucella spp.
RDEDMTSTGKR

SEQ ID NO: 8220 - protein, 5 aa, Brucella spp.
DDDGT

SEQ ID NO: 8221 - protein, 10 aa, Brucella spp.
SADLSGPVGD

SEQ ID NO: 8222 - protein, 9 aa, Brucella spp.
QSAPLYTNT

SEQ ID NO: 8223 - protein, 4 aa, Brucella spp.
SNTA

SEQ ID NO: 8224 - protein, 11 aa, Brucella spp.
GFGGPQGMAGA

SEQ ID NO: 8225 - protein, 5 aa, Brucella spp.
DPLEI

SEQ ID NO: 8226 - protein, 13 aa, Brucella spp.
MGKDGTRNVTPYH

SEQ ID NO: 8227 - protein, 11 aa, Brucella spp.
EESADYAKRRE

SEQ ID NO: 8228 - protein, 5 aa, Brucella spp.
KSRYV

SEQ ID NO: 8229 - protein, 8 aa, Brucella spp.
KTESNQAG

SEQ ID NO: 8230 - protein, 8 aa, Brucella spp.
HGGTEMGQ

SEQ ID NO: 8231 - protein, 34 aa, Brucella spp.
TATTTAKVPNTAPTAASSGADLNGMAAQDAARQI

SEQ ID NO: 8232 - protein, 4 aa, Brucella spp.
YQVP

SEQ ID NO: 8233 - protein, 4 aa, Brucella spp.
VGNQ

SEQ ID NO: 8234 - protein, 7 aa, Brucella spp.
AGHYKTP

SEQ ID NO: 8235 - protein, 6 aa, Brucella spp.
AKGRGH

SEQ ID NO: 8236 - protein, 7 aa, Brucella spp.
DTGRSLN

SEQ ID NO: 8237 - protein, 11 aa, Brucella spp.
GRLRTHAPSTY

SEQ ID NO: 8238 - protein, 6 aa, Brucella spp.
ASDRPK

SEQ ID NO: 8239 - protein, 8 aa, Brucella spp.
EAYEPTIH

SEQ ID NO: 8240 - protein, 9 aa, Brucella spp.
KAVGEPPLP

SEQ ID NO: 8241 - protein, 7 aa, Brucella spp.
DAPATPE

SEQ ID NO: 8242 - protein, 6 aa, Brucella spp.
LPPQTQ

SEQ ID NO: 8243 - protein, 16 aa, Brucella spp.
QPGGGSDRAELDEGAE

SEQ ID NO: 8244 - protein, 9 aa, Brucella spp.
GKTHRLDEG

SEQ ID NO: 8245 - protein, 8 aa, Brucella spp.
AYLPPKSG

SEQ ID NO: 8246 - protein, 7 aa, Brucella spp.
NEGATTA

SEQ ID NO: 8247 - protein, 13 aa, Brucella spp.
IAPSPMPDTGGAW

SEQ ID NO: 8248 - protein, 6 aa, Brucella spp.
AGGPGK

SEQ ID NO: 8249 - protein, 8 aa, Brucella spp.
AGAASNAR

SEQ ID NO: 8250 - protein, 4 aa, Brucella spp.
STNE

SEQ ID NO: 8251 - protein, 9 aa, Brucella spp.
SGGTYFSSG

SEQ ID NO: 8252 - protein, 15 aa, Brucella spp.
ESGEKRSEGLSAREN

SEQ ID NO: 8253 - protein, 8 aa, Brucella spp.
EGGSNREI

SEQ ID NO: 8254 - protein, 9 aa, Brucella spp.
ATVETHRKN

SEQ ID NO: 8255 - protein, 8 aa, Brucella spp.
GIASTAGL

SEQ ID NO: 8256 - protein, 7 aa, Brucella spp.
TTRDPGF

SEQ ID NO: 8257 - protein, 7 aa, Brucella spp.
GKPLTRA

SEQ ID NO: 8258 - protein, 7 aa, Brucella spp.
PNGPLTS

SEQ ID NO: 8259 - protein, 5 aa, Brucella spp.
KPVGT

SEQ ID NO: 8260 - protein, 5 aa, Brucella spp.
ELPQD

SEQ ID NO: 8261 - protein, 10 aa, Brucella spp.
TREPYKNRGR

SEQ ID NO: 8262 - protein, 22 aa, Brucella spp.
GFTEGSQSEPGEFVIEKAFVEK

SEQ ID NO: 8263 - protein, 4 aa, Brucella spp.
YTTP

SEQ ID NO: 8264 - protein, 11 aa, Brucella spp.
SYQESKEQAFR

SEQ ID NO: 8265 - protein, 5 aa, Brucella spp.
ETGCD

SEQ ID NO: 8266 - protein, 8 aa, Brucella spp.
LEGGEEMA

SEQ ID NO: 8267 - protein, 22 aa, Brucella spp.
SLGRGDDEAGKIRRDAQAIAQA

SEQ ID NO: 8268 - protein, 8 aa, Brucella spp.
GASSACDG

SEQ ID NO: 8269 - protein, 12 aa, Brucella spp.
QVSQAAEAYAEE

SEQ ID NO: 8270 - protein, 16 aa, Brucella spp.
RRFPGPEHVFGAKPGA

SEQ ID NO: 8271 - protein, 9 aa, Brucella spp.
APARQQGKK

SEQ ID NO: 8272 - protein, 15 aa, Brucella spp.
ANEDLGRYPRDLERD

SEQ ID NO: 8273 - protein, 15 aa, Brucella spp.
PPLGNQMEGEARPGH

SEQ ID NO: 8274 - protein, 10 aa, Brucella spp.
VREDDGLACS

SEQ ID NO: 8275 - protein, 5 aa, Brucella spp.
TPEQR

SEQ ID NO: 8276 - protein, 9 aa, Brucella spp.
SGMDDPDAL

SEQ ID NO: 8277 - protein, 5 aa, Brucella spp.
DPETL

SEQ ID NO: 8278 - protein, 5 aa, Brucella spp.
SAAMA

SEQ ID NO: 8279 - protein, 8 aa, Brucella spp.
GDIGGRPD

SEQ ID NO: 8280 - protein, 4 aa, Brucella spp.
GAGV

SEQ ID NO: 8281 - protein, 10 aa, Brucella spp.
HQIGSEEGSI

SEQ ID NO: 8282 - protein, 20 aa, Brucella spp.
GGFSAAARTINATQSTVSKA

SEQ ID NO: 8283 - protein, 4 aa, Brucella spp.
KQLE

SEQ ID NO: 8284 - protein, 8 aa, Brucella spp.
VSPPRLTA

SEQ ID NO: 8285 - protein, 4 aa, Brucella spp.
PPIG

SEQ ID NO: 8286 - protein, 4 aa, Brucella spp.
GSKR

SEQ ID NO: 8287 - protein, 11 aa, Brucella spp.
SHPVSDDDGVT

SEQ ID NO: 8288 - protein, 10 aa, Brucella spp.
QEDDYSKGVN

SEQ ID NO: 8289 - protein, 8 aa, Brucella spp.
ATDRAPQV

SEQ ID NO: 8290 - protein, 8 aa, Brucella spp.
SRALNKDE

SEQ ID NO: 8291 - protein, 7 aa, Brucella spp.
DREHGRE

SEQ ID NO: 8292 - protein, 4 aa, Brucella spp.
RPVD

SEQ ID NO: 8293 - protein, 12 aa, Brucella spp.
EISSQLGGTTIQ

SEQ ID NO: 8294 - protein, 6 aa, Brucella spp.
KNFSDK

SEQ ID NO: 8295 - protein, 7 aa, Brucella spp.
NNGTARE

SEQ ID NO: 8296 - protein, 20 aa, Brucella spp.
TAGSAGSGAGGTRNISGNNH

SEQ ID NO: 8297 - protein, 4 aa, Brucella spp.
HGKE

SEQ ID NO: 8298 - protein, 6 aa, Brucella spp.
NEASIS

SEQ ID NO: 8299 - protein, 7 aa, Brucella spp.
RRSGAEK

SEQ ID NO: 8300 - protein, 7 aa, Brucella spp.
AADRSRA

SEQ ID NO: 8301 - protein, 10 aa, Brucella spp.
HGGGITERDG

SEQ ID NO: 8302 - protein, 11 aa, Brucella spp.
LPPAVAAAATA

SEQ ID NO: 8303 - protein, 19 aa, Brucella spp.
SSQAERDGQQRQAQRAKDV

SEQ ID NO: 8304 - protein, 6 aa, Brucella spp.
KKASDR

SEQ ID NO: 8305 - protein, 7 aa, Brucella spp.
TVPRGTE

SEQ ID NO: 8306 - protein, 6 aa, Brucella spp.
TPSPLH

SEQ ID NO: 8307 - protein, 12 aa, Brucella spp.
AEPSAPQAANSD

SEQ ID NO: 8308 - protein, 17 aa, Brucella spp.
GDPKTTLAAAREAGATI

SEQ ID NO: 8309 - protein, 16 aa, Brucella spp.
KKREEAKPAPAAPSEE

SEQ ID NO: 8310 - protein, 7 aa, Brucella spp.
CGNPDGK

SEQ ID NO: 8311 - protein, 9 aa, Brucella spp.
GPGGGITPT

SEQ ID NO: 8312 - protein, 15 aa, Brucella spp.
GCGRSTPHAELRENT

SEQ ID NO: 8313 - protein, 4 aa, Brucella spp.
WGST

SEQ ID NO: 8314 - protein, 6 aa, Brucella spp.
ETHPER

SEQ ID NO: 8315 - protein, 8 aa, Brucella spp.
IPEAERGD

SEQ ID NO: 8316 - protein, 7 aa, Brucella spp.
TDRDPRV

SEQ ID NO: 8317 - protein, 6 aa, Brucella spp.
PDPARV

SEQ ID NO: 8318 - protein, 5 aa, Brucella spp.
AFGED

SEQ ID NO: 8319 - protein, 10 aa, Brucella spp.
EDSGHAVTEP

SEQ ID NO: 8320 - protein, 11 aa, Brucella spp.
AEKAGSFAGAP

SEQ ID NO: 8321 - protein, 5 aa, Brucella spp.
QVRAT

SEQ ID NO: 8322 - protein, 5 aa, Brucella spp.
HFAGQ

SEQ ID NO: 8323 - protein, 5 aa, Brucella spp.
EVSRG

SEQ ID NO: 8324 - protein, 5 aa, Brucella spp.
LPLGP

SEQ ID NO: 8325 - protein, 10 aa, Brucella spp.
QAAGNNDPTA

SEQ ID NO: 8326 - protein, 6 aa, Brucella spp.
DSRLEQ

SEQ ID NO: 8327 - protein, 20 aa, Brucella spp.
AGIRGPAAENVAVGQPDTQA

SEQ ID NO: 8328 - protein, 6 aa, Brucella spp.
SPGHRK

SEQ ID NO: 8329 - protein, 17 aa, Brucella spp.
TPESNPRRIYWAMMLGL

SEQ ID NO: 8330 - protein, 5 aa, Brucella spp.
SKPQE

SEQ ID NO: 8331 - protein, 6 aa, Brucella spp.
GDTPGR

SEQ ID NO: 8332 - protein, 6 aa, Brucella spp.
QIQPAS

SEQ ID NO: 8333 - protein, 8 aa, Brucella spp.
MPGPGTPV

SEQ ID NO: 8334 - protein, 16 aa, Brucella spp.
SPELSASANPKSSTGR

SEQ ID NO: 8335 - protein, 14 aa, Brucella spp.
GAQEFDKVPAGYKG

SEQ ID NO: 8336 - protein, 4 aa, Brucella spp.
GSRL

SEQ ID NO: 8337 - protein, 9 aa, Brucella spp.
GRAQLDESE

SEQ ID NO: 8338 - protein, 8 aa, Brucella spp.
MPNISGGG

SEQ ID NO: 8339 - protein, 7 aa, Brucella spp.
LSGGEDR

SEQ ID NO: 8340 - protein, 4 aa, Brucella spp.
HHTG

SEQ ID NO: 8341 - protein, 5 aa, Brucella spp.
KRAAH

SEQ ID NO: 8342 - protein, 11 aa, Brucella spp.
HSAAGGTGSRA

SEQ ID NO: 8343 - protein, 15 aa, Brucella spp.
SNYQAQQLKLSKHFR

SEQ ID NO: 8344 - protein, 8 aa, Brucella spp.
QSEPEENR

SEQ ID NO: 8345 - protein, 7 aa, Brucella spp.
NNSSETV

SEQ ID NO: 8346 - protein, 14 aa, Brucella spp.
ANGHVQEVRGSGVV

SEQ ID NO: 8347 - protein, 23 aa, Brucella spp.
KQPVLDPGDSYQYSSGCPLTTSS

SEQ ID NO: 8348 - protein, 8 aa, Brucella spp.
MKGEDGAQ

SEQ ID NO: 8349 - protein, 7 aa, Brucella spp.
AENIQTG

SEQ ID NO: 8350 - protein, 4 aa, Brucella spp.
LGPS

SEQ ID NO: 8351 - protein, 5 aa, Brucella spp.
EYPEE

SEQ ID NO: 8352 - protein, 7 aa, Brucella spp.
TQSDGPV

SEQ ID NO: 8353 - protein, 5 aa, Brucella spp.
TPRSV

SEQ ID NO: 8354 - protein, 4 aa, Brucella spp.
YDEA

SEQ ID NO: 8355 - protein, 11 aa, Brucella spp.
AANKTRPEELL

SEQ ID NO: 8356 - protein, 9 aa, Brucella spp.
VAPDGSTLE

SEQ ID NO: 8357 - protein, 6 aa, Brucella spp.
EQIPTD

SEQ ID NO: 8358 - protein, 12 aa, Brucella spp.
ERGADGKPVEQW

SEQ ID NO: 8359 - protein, 11 aa, Brucella spp.
DLPGGDGDDSQ

SEQ ID NO: 8360 - protein, 8 aa, Brucella spp.
EDDAWDEA

SEQ ID NO: 8361 - protein, 13 aa, Brucella spp.
ESSELTDPQVGSE

SEQ ID NO: 8362 - protein, 4 aa, Brucella spp.
SREK

SEQ ID NO: 8363 - protein, 13 aa, Brucella spp.
AEEIKDSVEDGKI

SEQ ID NO: 8364 - protein, 4 aa, Brucella spp.
VPAT

SEQ ID NO: 8365 - protein, 18 aa, Brucella spp.
AKARKARLKAGEVERPYA

SEQ ID NO: 8366 - protein, 4 aa, Brucella spp.
TRTR

SEQ ID NO: 8367 - protein, 11 aa, Brucella spp.
QLGRSETIADT

SEQ ID NO: 8368 - protein, 5 aa, Brucella spp.
TDDTH

SEQ ID NO: 8369 - protein, 8 aa, Brucella spp.
EHRGPIKG

SEQ ID NO: 8370 - protein, 12 aa, Brucella spp.
ATPKGSEPKSQY

SEQ ID NO: 8371 - protein, 19 aa, Brucella spp.
NGAGIMSTTDPEKAASGAD

SEQ ID NO: 8372 - protein, 7 aa, Brucella spp.
QEDHARG

SEQ ID NO: 8373 - protein, 6 aa, Brucella spp.
AKADPK

SEQ ID NO: 8374 - protein, 6 aa, Brucella spp.
RGEEVT

SEQ ID NO: 8375 - protein, 6 aa, Brucella spp.
VIDGPQ

SEQ ID NO: 8376 - protein, 4 aa, Brucella spp.
NRLH

SEQ ID NO: 8377 - protein, 4 aa, Brucella spp.
KTQA

SEQ ID NO: 8378 - protein, 7 aa, Brucella spp.
PAQEKLG

SEQ ID NO: 8379 - protein, 6 aa, Brucella spp.
NSGAEA

SEQ ID NO: 8380 - protein, 8 aa, Brucella spp.
IAAGGQAK

SEQ ID NO: 8381 - protein, 4 aa, Brucella spp.
PKVE

SEQ ID NO: 8382 - protein, 6 aa, Brucella spp.
ITPETA

SEQ ID NO: 8383 - protein, 6 aa, Brucella spp.
QGEGGL

SEQ ID NO: 8384 - protein, 7 aa, Brucella spp.
QTGVGRT

SEQ ID NO: 8385 - protein, 5 aa, Brucella spp.
IGGGF

SEQ ID NO: 8386 - protein, 9 aa, Brucella spp.
AEAAKGMTA

SEQ ID NO: 8387 - protein, 9 aa, Brucella spp.
GTTYGGNPL

SEQ ID NO: 8388 - protein, 9 aa, Brucella spp.
TTPEEAREA

SEQ ID NO: 8389 - protein, 12 aa, Brucella spp.
APEQARRSPNEA

SEQ ID NO: 8390 - protein, 5 aa, Brucella spp.
NQSTL

SEQ ID NO: 8391 - protein, 5 aa, Brucella spp.
TDERQ

SEQ ID NO: 8392 - protein, 15 aa, Brucella spp.
ERRGELASEWSAETA

SEQ ID NO: 8393 - protein, 16 aa, Brucella spp.
AVDSAKVAPTGEARPA

SEQ ID NO: 8394 - protein, 5 aa, Brucella spp.
PAGVP

SEQ ID NO: 8395 - protein, 6 aa, Brucella spp.
AATSIS

SEQ ID NO: 8396 - protein, 9 aa, Brucella spp.
YKELDDHSR

SEQ ID NO: 8397 - protein, 7 aa, Brucella spp.
LNDAGAK

SEQ ID NO: 8398 - protein, 4 aa, Brucella spp.
LPSI

SEQ ID NO: 8399 - protein, 13 aa, Brucella spp.
LAQGRAKSFNPVP

SEQ ID NO: 8400 - protein, 9 aa, Brucella spp.
TGGTTGISK

SEQ ID NO: 8401 - protein, 7 aa, Brucella spp.
NKGKPKA

SEQ ID NO: 8402 - protein, 4 aa, Brucella spp.
PRDI

SEQ ID NO: 8403 - protein, 8 aa, Brucella spp.
GLSETSPV

SEQ ID NO: 8404 - protein, 6 aa, Brucella spp.
ATEFTG

SEQ ID NO: 8405 - protein, 11 aa, Brucella spp.
RDDDGSDLPLG

SEQ ID NO: 8406 - protein, 8 aa, Brucella spp.
NRPEETAR

SEQ ID NO: 8407 - protein, 6 aa, Brucella spp.
AEHPGV

SEQ ID NO: 8408 - protein, 9 aa, Brucella spp.
GIPNEHSGE

SEQ ID NO: 8409 - protein, 8 aa, Brucella spp.
DPELTEDE

SEQ ID NO: 8410 - protein, 8 aa, Brucella spp.
NYKRPREV

SEQ ID NO: 8411 - protein, 17 aa, Brucella spp.
SLPKSNVGKILRRELRD

SEQ ID NO: 8412 - protein, 6 aa, Brucella spp.
SAQGDE

SEQ ID NO: 8413 - protein, 4 aa, Brucella spp.
AGPQ

SEQ ID NO: 8414 - protein, 11 aa, Brucella spp.
TNDSEAGARVT

SEQ ID NO: 8415 - protein, 10 aa, Brucella spp.
TAARPKPFPD

SEQ ID NO: 8416 - protein, 7 aa, Brucella spp.
AHAAGAG

SEQ ID NO: 8417 - protein, 11 aa, Brucella spp.
SGNSPREALEP

SEQ ID NO: 8418 - protein, 5 aa, Brucella spp.
VPGNA

SEQ ID NO: 8419 - protein, 11 aa, Brucella spp.
GKDAKAPGAYL

SEQ ID NO: 8420 - protein, 7 aa, Brucella spp.
GAELPGQ

SEQ ID NO: 8421 - protein, 6 aa, Brucella spp.
AAEEGR

SEQ ID NO: 8422 - protein, 9 aa, Brucella spp.
QANPIGSNQ

SEQ ID NO: 8423 - protein, 11 aa, Brucella spp.
TSDLPGPDAPV

SEQ ID NO: 8424 - protein, 7 aa, Brucella spp.
RDDEGEN

SEQ ID NO: 8425 - protein, 9 aa, Brucella spp.
ADKRNMKRR

SEQ ID NO: 8426 - protein, 8 aa, Brucella spp.
MGRGDAEG

SEQ ID NO: 8427 - protein, 6 aa, Brucella spp.
KLDGEY

SEQ ID NO: 8428 - protein, 4 aa, Brucella spp.
APEG

SEQ ID NO: 8429 - protein, 5 aa, Brucella spp.
VVEAG

SEQ ID NO: 8430 - protein, 9 aa, Brucella spp.
TRPGEPEGD

SEQ ID NO: 8431 - protein, 7 aa, Brucella spp.
TAPQAGR

SEQ ID NO: 8432 - protein, 15 aa, Brucella spp.
DKPSAVKKRAGALEA

SEQ ID NO: 8433 - protein, 8 aa, Brucella spp.
AESAPRDM

SEQ ID NO: 8434 - protein, 8 aa, Brucella spp.
SADPGRFG

SEQ ID NO: 8435 - protein, 4 aa, Brucella spp.
VNDE

SEQ ID NO: 8436 - protein, 6 aa, Brucella spp.
DVEGRR

SEQ ID NO: 8437 - protein, 7 aa, Brucella spp.
INNTEDR

SEQ ID NO: 8438 - protein, 6 aa, Brucella spp.
DTSSKE

SEQ ID NO: 8439 - protein, 15 aa, Brucella spp.
GIRSGALKGATGRKI

SEQ ID NO: 8440 - protein, 6 aa, Brucella spp.
GGSDLG

SEQ ID NO: 8441 - protein, 5 aa, Brucella spp.
YHDEP

SEQ ID NO: 8442 - protein, 7 aa, Brucella spp.
LSPLDPA

SEQ ID NO: 8443 - protein, 7 aa, Brucella spp.
TNAQTAR

SEQ ID NO: 8444 - protein, 4 aa, Brucella spp.
LGEA

SEQ ID NO: 8445 - protein, 21 aa, Brucella spp.
MESNGKSVTLDGKPVSGPTGP

SEQ ID NO: 8446 - protein, 7 aa, Brucella spp.
EPGTNGQ

SEQ ID NO: 8447 - protein, 4 aa, Brucella spp.
GTDT

SEQ ID NO: 8448 - protein, 7 aa, Brucella spp.
GHEPTLD

SEQ ID NO: 8449 - protein, 20 aa, Brucella spp.
RTLDEARAQLQAKNLPASQV

SEQ ID NO: 8450 - protein, 6 aa, Brucella spp.
SGNRPS

SEQ ID NO: 8451 - protein, 15 aa, Brucella spp.
SGKEGASGRDASTQG

SEQ ID NO: 8452 - protein, 17 aa, Brucella spp.
IDAGSPDIRGARLPAGD

SEQ ID NO: 8453 - protein, 5 aa, Brucella spp.
PPLSP

SEQ ID NO: 8454 - protein, 10 aa, Brucella spp.
AGNPAGAART

SEQ ID NO: 8455 - protein, 6 aa, Brucella spp.
AEGKPV

SEQ ID NO: 8456 - protein, 12 aa, Brucella spp.
NHPFTRAAETGR

SEQ ID NO: 8457 - protein, 8 aa, Brucella spp.
AGPAGISA

SEQ ID NO: 8458 - protein, 9 aa, Brucella spp.
RPKGGGLNE

SEQ ID NO: 8459 - protein, 9 aa, Brucella spp.
LAGEDAPNV

SEQ ID NO: 8460 - protein, 7 aa, Brucella spp.
KKLGANN

SEQ ID NO: 8461 - protein, 13 aa, Brucella spp.
GQESMNASAYEQE

SEQ ID NO: 8462 - protein, 6 aa, Brucella spp.
ERSEDG

SEQ ID NO: 8463 - protein, 12 aa, Brucella spp.
TANRDGKLVGTG

SEQ ID NO: 8464 - protein, 11 aa, Brucella spp.
TFDPEPLRGSG

SEQ ID NO: 8465 - protein, 10 aa, Brucella spp.
SVDAEGRTSV

SEQ ID NO: 8466 - protein, 8 aa, Brucella spp.
CVAGGKDL

SEQ ID NO: 8467 - protein, 8 aa, Brucella spp.
ASVEDGKV

SEQ ID NO: 8468 - protein, 8 aa, Brucella spp.
TSRPEAVE

SEQ ID NO: 8469 - protein, 24 aa, Brucella spp.
AHHAPAAPSRHATVQPGSEQGLGD

SEQ ID NO: 8470 - protein, 4 aa, Brucella spp.
SPNP

SEQ ID NO: 8471 - protein, 8 aa, Brucella spp.
APPTDKAY

SEQ ID NO: 8472 - protein, 7 aa, Brucella spp.
GAEGPPV

SEQ ID NO: 8473 - protein, 6 aa, Brucella spp.
NGPRYG

SEQ ID NO: 8474 - protein, 6 aa, Brucella spp.
ETGADG

SEQ ID NO: 8475 - protein, 6 aa, Brucella spp.
SERGMG

SEQ ID NO: 8476 - protein, 4 aa, Brucella spp.
PNIT

SEQ ID NO: 8477 - protein, 14 aa, Brucella spp.
RKPARAAFANGTDA

SEQ ID NO: 8478 - protein, 17 aa, Brucella spp.
SPVPSIDGRGSHGGYCG

SEQ ID NO: 8479 - protein, 9 aa, Brucella spp.
RDAETAGLP

SEQ ID NO: 8480 - protein, 7 aa, Brucella spp.
SKGYQTL

SEQ ID NO: 8481 - protein, 6 aa, Brucella spp.
DTSHQA

SEQ ID NO: 8482 - protein, 10 aa, Brucella spp.
GVDPRTKAPI

SEQ ID NO: 8483 - protein, 15 aa, Brucella spp.
TTHPNNPAAMKEAAE

SEQ ID NO: 8484 - protein, 9 aa, Brucella spp.
IDPDGDPLE

SEQ ID NO: 8485 - protein, 9 aa, Brucella spp.
SASKPEASR

SEQ ID NO: 8486 - protein, 8 aa, Brucella spp.
PRAEAANF

SEQ ID NO: 8487 - protein, 22 aa, Brucella spp.
GPGLRGGNNRQTLTDEDGEGRR

SEQ ID NO: 8488 - protein, 11 aa, Brucella spp.
RPGEDSDADPV

SEQ ID NO: 8489 - protein, 9 aa, Brucella spp.
DTQPTGGKF

SEQ ID NO: 8490 - protein, 7 aa, Brucella spp.
NEEGTRF

SEQ ID NO: 8491 - protein, 13 aa, Brucella spp.
YERTDAKGKTFGE

SEQ ID NO: 8492 - protein, 8 aa, Brucella spp.
GDEPVGSR

SEQ ID NO: 8493 - protein, 12 aa, Brucella spp.
GKEAHTGSTPMR

SEQ ID NO: 8494 - protein, 4 aa, Brucella spp.
ASLG

SEQ ID NO: 8495 - protein, 7 aa, Brucella spp.
QPDAVGG

SEQ ID NO: 8496 - protein, 9 aa, Brucella spp.
VSPNSRNVL

SEQ ID NO: 8497 - protein, 8 aa, Brucella spp.
SPNQATLD

SEQ ID NO: 8498 - protein, 10 aa, Brucella spp.
FEKEAPKIAE

SEQ ID NO: 8499 - protein, 5 aa, Brucella spp.
AERLG

SEQ ID NO: 8500 - protein, 4 aa, Brucella spp.
SGAG

SEQ ID NO: 8501 - protein, 17 aa, Brucella spp.
SHNEDEDISKEWASAGT

SEQ ID NO: 8502 - protein, 4 aa, Brucella spp.
GGTV

SEQ ID NO: 8503 - protein, 11 aa, Brucella spp.
AIGDSLEGDEV

SEQ ID NO: 8504 - protein, 17 aa, Brucella spp.
SSDDFDTGTAAALAGGT

SEQ ID NO: 8505 - protein, 6 aa, Brucella spp.
DSEGNL

SEQ ID NO: 8506 - protein, 8 aa, Brucella spp.
AGKARTDY

SEQ ID NO: 8507 - protein, 24 aa, Brucella spp.
AEGNDGPEAHAYSRPPEVEGEATN

SEQ ID NO: 8508 - protein, 5 aa, Brucella spp.
QSHEA

SEQ ID NO: 8509 - protein, 6 aa, Brucella spp.
RRARQK

SEQ ID NO: 8510 - protein, 7 aa, Brucella spp.
ESEYHNR

SEQ ID NO: 8511 - protein, 8 aa, Brucella spp.
TEQKRYGI

SEQ ID NO: 8512 - protein, 10 aa, Brucella spp.
IPNGTGGLEE

SEQ ID NO: 8513 - protein, 7 aa, Brucella spp.
RTGRLTP

SEQ ID NO: 8514 - protein, 7 aa, Brucella spp.
AVVPGAD

SEQ ID NO: 8515 - protein, 15 aa, Brucella spp.
EATKKISAKTQHSSI

SEQ ID NO: 8516 - protein, 12 aa, Brucella spp.
GQVTAKPGDGRF

SEQ ID NO: 8517 - protein, 8 aa, Brucella spp.
REPNGAVN

SEQ ID NO: 8518 - protein, 14 aa, Brucella spp.
RKVERSAEHMPIGV

SEQ ID NO: 8519 - protein, 8 aa, Brucella spp.
NNNGAAQL

SEQ ID NO: 8520 - protein, 24 aa, Brucella spp.
LSSGDAPGNVSQAQPKKQPKNHAA

SEQ ID NO: 8521 - protein, 7 aa, Brucella spp.
AGEETIN

SEQ ID NO: 8522 - protein, 6 aa, Brucella spp.
GSARAL

SEQ ID NO: 8523 - protein, 7 aa, Brucella spp.
VTPYSSG

SEQ ID NO: 8524 - protein, 9 aa, Brucella spp.
AGDTVKEGD

SEQ ID NO: 8525 - protein, 6 aa, Brucella spp.
AETEQI

SEQ ID NO: 8526 - protein, 15 aa, Brucella spp.
KAETALKDAQTTRQR

SEQ ID NO: 8527 - protein, 9 aa, Brucella spp.
ATNTATEVQ

SEQ ID NO: 8528 - protein, 6 aa, Brucella spp.
NYVTAQ

SEQ ID NO: 8529 - protein, 4 aa, Brucella spp.
IDDR

SEQ ID NO: 8530 - protein, 14 aa, Brucella spp.
GQPLTAESTAFPGE

SEQ ID NO: 8531 - protein, 9 aa, Brucella spp.
EVPNAEDRL

SEQ ID NO: 8532 - protein, 7 aa, Brucella spp.
DNYPSVD

SEQ ID NO: 8533 - protein, 29 aa, Brucella spp.
QTVRDDAPVRVKGEQGVSALAPAAMHDEG

SEQ ID NO: 8534 - protein, 32 aa, Brucella spp.
FSRSKQEHMTEKTTPREKLTEADYRKKRLAEQ

SEQ ID NO: 8535 - protein, 27 aa, Brucella spp.
KAQSRSRRAGEADERNDGITAGHGKEE

SEQ ID NO: 8536 - protein, 6 aa, Brucella spp.
AQKVNS

SEQ ID NO: 8537 - protein, 7 aa, Brucella spp.
SGAKNAA

SEQ ID NO: 8538 - protein, 15 aa, Brucella spp.
SVNGRREHQNGPYSR

SEQ ID NO: 8539 - protein, 6 aa, Brucella spp.
DTTAPY

SEQ ID NO: 8540 - protein, 5 aa, Brucella spp.
VSLPG

SEQ ID NO: 8541 - protein, 13 aa, Brucella spp.
ENGYAKAKARNGL

SEQ ID NO: 8542 - protein, 6 aa, Brucella spp.
AKGETI

SEQ ID NO: 8543 - protein, 8 aa, Brucella spp.
AAREPEVA

SEQ ID NO: 8544 - protein, 10 aa, Brucella spp.
KISGAGSSTI

SEQ ID NO: 8545 - protein, 4 aa, Brucella spp.
NLSG

SEQ ID NO: 8546 - protein, 6 aa, Brucella spp.
GAQESQ

SEQ ID NO: 8547 - protein, 11 aa, Brucella spp.
AGAEINETNSG

SEQ ID NO: 8548 - protein, 8 aa, Brucella spp.
TDPFPGFP

SEQ ID NO: 8549 - protein, 7 aa, Brucella spp.
AKGTSHI

SEQ ID NO: 8550 - protein, 12 aa, Brucella spp.
SLSGQTATVEGV

SEQ ID NO: 8551 - protein, 5 aa, Brucella spp.
AEGET

SEQ ID NO: 8552 - protein, 12 aa, Brucella spp.
SRCGADVKRISG

SEQ ID NO: 8553 - protein, 9 aa, Brucella spp.
KREVSEDVD

SEQ ID NO: 8554 - protein, 7 aa, Brucella spp.
RREGDSA

SEQ ID NO: 8555 - protein, 8 aa, Brucella spp.
DAAPASTV

SEQ ID NO: 8556 - protein, 12 aa, Brucella spp.
ARQLPKDDRYTD

SEQ ID NO: 8557 - protein, 10 aa, Brucella spp.
PGGTASYPSS

SEQ ID NO: 8558 - protein, 6 aa, Brucella spp.
APDGNL

SEQ ID NO: 8559 - protein, 5 aa, Brucella spp.
TETIR

SEQ ID NO: 8560 - protein, 6 aa, Brucella spp.
VGPGNA

SEQ ID NO: 8561 - protein, 7 aa, Brucella spp.
KDNNPDW

SEQ ID NO: 8562 - protein, 7 aa, Brucella spp.
AEHDTAA

SEQ ID NO: 8563 - protein, 10 aa, Brucella spp.
RTETASASWR

SEQ ID NO: 8564 - protein, 8 aa, Brucella spp.
ARSARFSS

SEQ ID NO: 8565 - protein, 16 aa, Brucella spp.
EGLDAHAQSVAIRLNL

SEQ ID NO: 8566 - protein, 18 aa, Brucella spp.
TSQSLDGSDAMNPDPDYS

SEQ ID NO: 8567 - protein, 7 aa, Brucella spp.
DDEALKG

SEQ ID NO: 8568 - protein, 6 aa, Brucella spp.
EIRAAP

SEQ ID NO: 8569 - protein, 6 aa, Brucella spp.
KQAGKP

SEQ ID NO: 8570 - protein, 6 aa, Brucella spp.
LSPEEI

SEQ ID NO: 8571 - protein, 10 aa, Brucella spp.
KAESGKAERI

SEQ ID NO: 8572 - protein, 12 aa, Brucella spp.
EPTSPDDVAGHR

SEQ ID NO: 8573 - protein, 7 aa, Brucella spp.
SGTKEGR

SEQ ID NO: 8574 - protein, 5 aa, Brucella spp.
MPPSL

SEQ ID NO: 8575 - protein, 9 aa, Brucella spp.
AAGQGIGQA

SEQ ID NO: 8576 - protein, 8 aa, Brucella spp.
ASSVKGVS

SEQ ID NO: 8577 - protein, 10 aa, Brucella spp.
GTVESPSLQD

SEQ ID NO: 8578 - protein, 9 aa, Brucella spp.
RAQGDYEAA

SEQ ID NO: 8579 - protein, 9 aa, Brucella spp.
GRIGQPEEI

SEQ ID NO: 8580 - protein, 17 aa, Brucella spp.
ATYTTGQAYNIDGGWSI

SEQ ID NO: 8581 - protein, 6 aa, Brucella spp.
RPSRPK

SEQ ID NO: 8582 - protein, 9 aa, Brucella spp.
PAYEKGGFP

SEQ ID NO: 8583 - protein, 9 aa, Brucella spp.
DLEKARKLA

SEQ ID NO: 8584 - protein, 5 aa, Brucella spp.
LPEGA

SEQ ID NO: 8585 - protein, 11 aa, Brucella spp.
KPMGSDLAGAT

SEQ ID NO: 8586 - protein, 7 aa, Brucella spp.
GNPQGVH

SEQ ID NO: 8587 - protein, 7 aa, Brucella spp.
SIGHPNH

SEQ ID NO: 8588 - protein, 6 aa, Brucella spp.
VAQTRT

SEQ ID NO: 8589 - protein, 7 aa, Brucella spp.
YPRGEPD

SEQ ID NO: 8590 - protein, 5 aa, Brucella spp.
PKGGD

SEQ ID NO: 8591 - protein, 6 aa, Brucella spp.
DELVGS

SEQ ID NO: 8592 - protein, 17 aa, Brucella spp.
YRSSAAPATPLAARPEV

SEQ ID NO: 8593 - protein, 10 aa, Brucella spp.
DSDGAVGTGY

SEQ ID NO: 8594 - protein, 8 aa, Brucella spp.
TIGTGGSS

SEQ ID NO: 8595 - protein, 4 aa, Brucella spp.
KQNL

SEQ ID NO: 8596 - protein, 5 aa, Brucella spp.
GGARD

SEQ ID NO: 8597 - protein, 10 aa, Brucella spp.
AKAKGFTGSK

SEQ ID NO: 8598 - protein, 10 aa, Brucella spp.
IGKPHGAQDY

SEQ ID NO: 8599 - protein, 6 aa, Brucella spp.
LPADDL

SEQ ID NO: 8600 - protein, 7 aa, Brucella spp.
STAAPVA

SEQ ID NO: 8601 - protein, 8 aa, Brucella spp.
LTDKGMEI

SEQ ID NO: 8602 - protein, 9 aa, Brucella spp.
AVAPSQPGI

SEQ ID NO: 8603 - protein, 15 aa, Brucella spp.
SRSIGEFTREIVRAP

SEQ ID NO: 8604 - protein, 4 aa, Brucella spp.
APAL

SEQ ID NO: 8605 - protein, 7 aa, Brucella spp.
AERAGIG

SEQ ID NO: 8606 - protein, 5 aa, Brucella spp.
QAETD

SEQ ID NO: 8607 - protein, 4 aa, Brucella spp.
RSGG

SEQ ID NO: 8608 - protein, 9 aa, Brucella spp.
SCRPEEPGF

SEQ ID NO: 8609 - protein, 5 aa, Brucella spp.
EVSEG

SEQ ID NO: 8610 - protein, 5 aa, Brucella spp.
LEGTG

SEQ ID NO: 8611 - protein, 9 aa, Brucella spp.
APDIKAGAL

SEQ ID NO: 8612 - protein, 4 aa, Brucella spp.
SRRP

SEQ ID NO: 8613 - protein, 8 aa, Brucella spp.
SSPDAGLS

SEQ ID NO: 8614 - protein, 7 aa, Brucella spp.
CSTTEKS

SEQ ID NO: 8615 - protein, 6 aa, Brucella spp.
DGSRKS

SEQ ID NO: 8616 - protein, 23 aa, Brucella spp.
DDTRGPTKGGIRYHPDSTVEEVE

SEQ ID NO: 8617 - protein, 21 aa, Brucella spp.
YGGGKGAIQVDPRQLSKAELE

SEQ ID NO: 8618 - protein, 11 aa, Brucella spp.
GPDRDIPAPDV

SEQ ID NO: 8619 - protein, 10 aa, Brucella spp.
VGQSSPAVIT

SEQ ID NO: 8620 - protein, 16 aa, Brucella spp.
ALGGSLGRNDATARGG

SEQ ID NO: 8621 - protein, 6 aa, Brucella spp.
SDSAGA

SEQ ID NO: 8622 - protein, 20 aa, Brucella spp.
KADGKSVISTAGHKGHEAIS

SEQ ID NO: 8623 - protein, 5 aa, Brucella spp.
NAASI

SEQ ID NO: 8624 - protein, 10 aa, Brucella spp.
NGPVTGDADK

SEQ ID NO: 8625 - protein, 4 aa, Brucella spp.
AGGV

SEQ ID NO: 8626 - protein, 5 aa, Brucella spp.
ERGVT

SEQ ID NO: 8627 - protein, 9 aa, Brucella spp.
SKIDTEGGV

SEQ ID NO: 8628 - protein, 8 aa, Brucella spp.
NGIKTTDR

SEQ ID NO: 8629 - protein, 5 aa, Brucella spp.
PEYTG

SEQ ID NO: 8630 - protein, 6 aa, Brucella spp.
DPLWKD

SEQ ID NO: 8631 - protein, 15 aa, Brucella spp.
PAKAYETAKKLDYDA

SEQ ID NO: 8632 - protein, 8 aa, Brucella spp.
PSPANNTW

SEQ ID NO: 8633 - protein, 12 aa, Brucella spp.
DVANENKLASLS

SEQ ID NO: 8634 - protein, 4 aa, Brucella spp.
LPAF

SEQ ID NO: 8635 - protein, 10 aa, Brucella spp.
SGGDTAATIA

SEQ ID NO: 8636 - protein, 10 aa, Brucella spp.
AAANQTNGAN

SEQ ID NO: 8637 - protein, 8 aa, Brucella spp.
TDGGIAPS

SEQ ID NO: 8638 - protein, 4 aa, Brucella spp.
VQPV

SEQ ID NO: 8639 - protein, 7 aa, Brucella spp.
KKDPKIE

SEQ ID NO: 8640 - protein, 11 aa, Brucella spp.
QLGGEPAKAVA

SEQ ID NO: 8641 - protein, 5 aa, Brucella spp.
DEIPG

SEQ ID NO: 8642 - protein, 8 aa, Brucella spp.
RPQSERDR

SEQ ID NO: 8643 - protein, 9 aa, Brucella spp.
DRSDLERPE

SEQ ID NO: 8644 - protein, 15 aa, Brucella spp.
RTELAEANRQASHAQ

SEQ ID NO: 8645 - protein, 13 aa, Brucella spp.
AASTASGQPIDEA

SEQ ID NO: 8646 - protein, 11 aa, Brucella spp.
KVERKDGTSRT

SEQ ID NO: 8647 - protein, 10 aa, Brucella spp.
IPPVEGNEPR

SEQ ID NO: 8648 - protein, 6 aa, Brucella spp.
TERREI

SEQ ID NO: 8649 - protein, 5 aa, Brucella spp.
TGLPN

SEQ ID NO: 8650 - protein, 7 aa, Brucella spp.
KKGSDCD

SEQ ID NO: 8651 - protein, 10 aa, Brucella spp.
DSISHQAGDQ

SEQ ID NO: 8652 - protein, 7 aa, Brucella spp.
PLHGDNP

SEQ ID NO: 8653 - protein, 9 aa, Brucella spp.
ASKSGGRRT

SEQ ID NO: 8654 - protein, 5 aa, Brucella spp.
ARWPE

SEQ ID NO: 8655 - protein, 8 aa, Brucella spp.
FGTGDSSL

SEQ ID NO: 8656 - protein, 10 aa, Brucella spp.
AEGVETAQQL

SEQ ID NO: 8657 - protein, 4 aa, Brucella spp.
ERFG

SEQ ID NO: 8658 - protein, 5 aa, Brucella spp.
RPMRA

SEQ ID NO: 8659 - protein, 14 aa, Brucella spp.
GGLGMARPHNTLAI

SEQ ID NO: 8660 - protein, 13 aa, Brucella spp.
NTDPSHEADHLVQ

SEQ ID NO: 8661 - protein, 7 aa, Brucella spp.
AEFTDQG

SEQ ID NO: 8662 - protein, 8 aa, Brucella spp.
SAEIGSDS

SEQ ID NO: 8663 - protein, 8 aa, Brucella spp.
GESAEEPV

SEQ ID NO: 8664 - protein, 4 aa, Brucella spp.
VRRK

SEQ ID NO: 8665 - protein, 10 aa, Brucella spp.
RRTEEHETID

SEQ ID NO: 8666 - protein, 4 aa, Brucella spp.
LEPD

SEQ ID NO: 8667 - protein, 5 aa, Brucella spp.
HLDPR

SEQ ID NO: 8668 - protein, 5 aa, Brucella spp.
KDISV

SEQ ID NO: 8669 - protein, 13 aa, Brucella spp.
GLAARDSLQDLRG

SEQ ID NO: 8670 - protein, 10 aa, Brucella spp.
ESDDRRGISV

SEQ ID NO: 8671 - protein, 6 aa, Brucella spp.
ARPAFA

SEQ ID NO: 8672 - protein, 8 aa, Brucella spp.
RVRRRGDT

SEQ ID NO: 8673 - protein, 18 aa, Brucella spp.
TNAQAEAETMTDFVEDYA

SEQ ID NO: 8674 - protein, 8 aa, Brucella spp.
AQYPSPSI

SEQ ID NO: 8675 - protein, 11 aa, Brucella spp.
RRESGEARAGQ

SEQ ID NO: 8676 - protein, 9 aa, Brucella spp.
AGCHTPREA

SEQ ID NO: 8677 - protein, 9 aa, Brucella spp.
DTDTLQPDP

SEQ ID NO: 8678 - protein, 11 aa, Brucella spp.
PIGSGRGFNNP

SEQ ID NO: 8679 - protein, 5 aa, Brucella spp.
GVPSH

SEQ ID NO: 8680 - protein, 9 aa, Brucella spp.
AKAGDPAAM

SEQ ID NO: 8681 - protein, 23 aa, Brucella spp.
EADPIEARDMASPSTPLLGKAFL

SEQ ID NO: 8682 - protein, 7 aa, Brucella spp.
GDGTLPK

SEQ ID NO: 8683 - protein, 8 aa, Brucella spp.
ANTSQETR

SEQ ID NO: 8684 - protein, 5 aa, Brucella spp.
EGISE

SEQ ID NO: 8685 - protein, 9 aa, Brucella spp.
ATREEPENL

SEQ ID NO: 8686 - protein, 9 aa, Brucella spp.
TARAGTPYQ

SEQ ID NO: 8687 - protein, 6 aa, Brucella spp.
AGSEYQ

SEQ ID NO: 8688 - protein, 15 aa, Brucella spp.
ARDRIGDDFEKSPRW

SEQ ID NO: 8689 - protein, 11 aa, Brucella spp.
LASGTSSRATK

SEQ ID NO: 8690 - protein, 10 aa, Brucella spp.
GRKKLPATRT

SEQ ID NO: 8691 - protein, 10 aa, Brucella spp.
RTDKAGEPLK

SEQ ID NO: 8692 - protein, 15 aa, Brucella spp.
RDAADRGAKIATRTS

SEQ ID NO: 8693 - protein, 9 aa, Brucella spp.
AASRDGQGW

SEQ ID NO: 8694 - protein, 10 aa, Brucella spp.
EDTGTGRREN

SEQ ID NO: 8695 - protein, 5 aa, Brucella spp.
AGPWA

SEQ ID NO: 8696 - protein, 7 aa, Brucella spp.
SVEGDRQ

SEQ ID NO: 8697 - protein, 4 aa, Brucella spp.
FSDP

SEQ ID NO: 8698 - protein, 21 aa, Brucella spp.
TTDQDYKGDPAKVAITDSETD

SEQ ID NO: 8699 - protein, 16 aa, Brucella spp.
PLYDDGASKAQEATRD

SEQ ID NO: 8700 - protein, 8 aa, Brucella spp.
EDAPDGLA

SEQ ID NO: 8701 - protein, 5 aa, Brucella spp.
LTTAR

SEQ ID NO: 8702 - protein, 5 aa, Brucella spp.
GAPWT

SEQ ID NO: 8703 - protein, 8 aa, Brucella spp.
APLPGGDF

SEQ ID NO: 8704 - protein, 8 aa, Brucella spp.
QASSLGDL

SEQ ID NO: 8705 - protein, 4 aa, Brucella spp.
WARS

SEQ ID NO: 8706 - protein, 7 aa, Brucella spp.
TPQTVRK

SEQ ID NO: 8707 - protein, 5 aa, Brucella spp.
YPSGV

SEQ ID NO: 8708 - protein, 10 aa, Brucella spp.
AHEKESIGRA

SEQ ID NO: 8709 - protein, 6 aa, Brucella spp.
TTTEAV

SEQ ID NO: 8710 - protein, 9 aa, Brucella spp.
RASDGGIVG

SEQ ID NO: 8711 - protein, 6 aa, Brucella spp.
AIDEDG

SEQ ID NO: 8712 - protein, 8 aa, Brucella spp.
TKLERTAP

SEQ ID NO: 8713 - protein, 22 aa, Brucella spp.
EKVGKRGRDSARGANALSQKGQ

SEQ ID NO: 8714 - protein, 4 aa, Brucella spp.
IPTS

SEQ ID NO: 8715 - protein, 7 aa, Brucella spp.
TKPAAVD

SEQ ID NO: 8716 - protein, 5 aa, Brucella spp.
SEGTV

SEQ ID NO: 8717 - protein, 7 aa, Brucella spp.
GAANRTE

SEQ ID NO: 8718 - protein, 4 aa, Brucella spp.
EAGR

SEQ ID NO: 8719 - protein, 16 aa, Brucella spp.
VQSKKDASPVTEADHA

SEQ ID NO: 8720 - protein, 10 aa, Brucella spp.
EVAAGRLPDH

SEQ ID NO: 8721 - protein, 12 aa, Brucella spp.
ETTPDHGAGQDQ

SEQ ID NO: 8722 - protein, 5 aa, Brucella spp.
SPAEK

SEQ ID NO: 8723 - protein, 7 aa, Brucella spp.
HLTPETE

SEQ ID NO: 8724 - protein, 7 aa, Brucella spp.
SSVSVGS

SEQ ID NO: 8725 - protein, 4 aa, Brucella spp.
EADI

SEQ ID NO: 8726 - protein, 6 aa, Brucella spp.
TAAGDA

SEQ ID NO: 8727 - protein, 7 aa, Brucella spp.
GGMTATL

SEQ ID NO: 8728 - protein, 8 aa, Brucella spp.
AGAAGFAN

SEQ ID NO: 8729 - protein, 9 aa, Brucella spp.
SVDDGKSTL

SEQ ID NO: 8730 - protein, 15 aa, Brucella spp.
SLKNDSRKFGTTDDD

SEQ ID NO: 8731 - protein, 8 aa, Brucella spp.
EAEREQGI

SEQ ID NO: 8732 - protein, 7 aa, Brucella spp.
TPGHAQY

SEQ ID NO: 8733 - protein, 10 aa, Brucella spp.
NMATGASTAD

SEQ ID NO: 8734 - protein, 4 aa, Brucella spp.
VLTQ

SEQ ID NO: 8735 - protein, 10 aa, Brucella spp.
DNVTASSPRI

SEQ ID NO: 8736 - protein, 8 aa, Brucella spp.
DTEAAAKP

SEQ ID NO: 8737 - protein, 7 aa, Brucella spp.
GTVASGS

SEQ ID NO: 8738 - protein, 8 aa, Brucella spp.
KSGKQSRV

SEQ ID NO: 8739 - protein, 14 aa, Brucella spp.
TYDGDLQRASEGQA

SEQ ID NO: 8740 - protein, 4 aa, Brucella spp.
LLPG

SEQ ID NO: 8741 - protein, 9 aa, Brucella spp.
TETDQTPVT

SEQ ID NO: 8742 - protein, 8 aa, Brucella spp.
PYGENRAT

SEQ ID NO: 8743 - protein, 5 aa, Brucella spp.
NATVG

SEQ ID NO: 8744 - protein, 10 aa, Brucella spp.
KQARAAQKFQ

SEQ ID NO: 8745 - protein, 11 aa, Brucella spp.
SASGKSTIANR

SEQ ID NO: 8746 - protein, 5 aa, Brucella spp.
VRHGL

SEQ ID NO: 8747 - protein, 11 aa, Brucella spp.
LGFSDADRVEN

SEQ ID NO: 8748 - protein, 6 aa, Brucella spp.
EERDQV

SEQ ID NO: 8749 - protein, 5 aa, Brucella spp.
ARLPE

SEQ ID NO: 8750 - protein, 6 aa, Brucella spp.
DPKGLY

SEQ ID NO: 8751 - protein, 9 aa, Brucella spp.
DSPYEPPVA

SEQ ID NO: 8752 - protein, 6 aa, Brucella spp.
TAGRTV

SEQ ID NO: 8753 - protein, 7 aa, Brucella spp.
RNRSSRF

SEQ ID NO: 8754 - protein, 5 aa, Brucella spp.
PAPPP

SEQ ID NO: 8755 - protein, 7 aa, Brucella spp.
AQAREKG

SEQ ID NO: 8756 - protein, 13 aa, Brucella spp.
EQGVRDGIGPFTH

SEQ ID NO: 8757 - protein, 14 aa, Brucella spp.
GGARRDEEKSRAKE

SEQ ID NO: 8758 - protein, 11 aa, Brucella spp.
HGWDPKNQRPE

SEQ ID NO: 8759 - protein, 7 aa, Brucella spp.
RVSKGES

SEQ ID NO: 8760 - protein, 8 aa, Brucella spp.
LRPGEPVE

SEQ ID NO: 8761 - protein, 9 aa, Brucella spp.
AIPSSAANL

SEQ ID NO: 8762 - protein, 26 aa, Brucella spp.
TSERQGRAIDRDEAGSMEKKKREGYF

SEQ ID NO: 8763 - protein, 9 aa, Brucella spp.
TAAKPDGSE

SEQ ID NO: 8764 - protein, 13 aa, Brucella spp.
NTFSSTSIAQADY

SEQ ID NO: 8765 - protein, 7 aa, Brucella spp.
RDGARLA

SEQ ID NO: 8766 - protein, 10 aa, Brucella spp.
RAEQKDGRRR

SEQ ID NO: 8767 - protein, 18 aa, Brucella spp.
LGPTNRTASLSPDVNNPG

SEQ ID NO: 8768 - protein, 13 aa, Brucella spp.
DLSGRTLSGQTPT

SEQ ID NO: 8769 - protein, 17 aa, Brucella spp.
AGLPNEFGQYDETPEAM

SEQ ID NO: 8770 - protein, 7 aa, Brucella spp.
CGSTPDH

SEQ ID NO: 8771 - protein, 11 aa, Brucella spp.
KYEPRKPAKVP

SEQ ID NO: 8772 - protein, 8 aa, Brucella spp.
RTNVTGSA

SEQ ID NO: 8773 - protein, 8 aa, Brucella spp.
RDQVANGA

SEQ ID NO: 8774 - protein, 4 aa, Brucella spp.
EPDI

SEQ ID NO: 8775 - protein, 6 aa, Brucella spp.
LKEGEE

SEQ ID NO: 8776 - protein, 10 aa, Brucella spp.
ETGQADTQAR

SEQ ID NO: 8777 - protein, 4 aa, Brucella spp.
GFPP

SEQ ID NO: 8778 - protein, 5 aa, Brucella spp.
EEHNN

SEQ ID NO: 8779 - protein, 6 aa, Brucella spp.
GNEPVR

SEQ ID NO: 8780 - protein, 11 aa, Brucella spp.
RPTKTGESATE

SEQ ID NO: 8781 - protein, 12 aa, Brucella spp.
RDSGSREARTQD

SEQ ID NO: 8782 - protein, 9 aa, Brucella spp.
ADTEEARLA

SEQ ID NO: 8783 - protein, 13 aa, Brucella spp.
KRLNGGEGRQSAG

SEQ ID NO: 8784 - protein, 6 aa, Brucella spp.
ATTSRV

SEQ ID NO: 8785 - protein, 5 aa, Brucella spp.
RYERG

SEQ ID NO: 8786 - protein, 9 aa, Brucella spp.
LSPEGKQAY

SEQ ID NO: 8787 - protein, 12 aa, Brucella spp.
AHARNEAEKQRL

SEQ ID NO: 8788 - protein, 6 aa, Brucella spp.
RANPHQ

SEQ ID NO: 8789 - protein, 7 aa, Brucella spp.
VKPTFTG

SEQ ID NO: 8790 - protein, 9 aa, Brucella spp.
DEKQGEAAR

SEQ ID NO: 8791 - protein, 8 aa, Brucella spp.
DESRKEEL

SEQ ID NO: 8792 - protein, 9 aa, Brucella spp.
TKRDGRPNV

SEQ ID NO: 8793 - protein, 8 aa, Brucella spp.
VESGKQDY

SEQ ID NO: 8794 - protein, 7 aa, Brucella spp.
ERANDDY

SEQ ID NO: 8795 - protein, 6 aa, Brucella spp.
DEAFTP

SEQ ID NO: 8796 - protein, 22 aa, Brucella spp.
EPYKGIRPAPGYPAQPDHTEKT

SEQ ID NO: 8797 - protein, 8 aa, Brucella spp.
TANTGVEL

SEQ ID NO: 8798 - protein, 14 aa, Brucella spp.
ERDQVEDYARRKDM

SEQ ID NO: 8799 - protein, 4 aa, Brucella spp.
KPPL

SEQ ID NO: 8800 - protein, 4 aa, Brucella spp.
EKPM

SEQ ID NO: 8801 - protein, 7 aa, Brucella spp.
SANAAQP

SEQ ID NO: 8802 - protein, 10 aa, Brucella spp.
AAASQDADAV

SEQ ID NO: 8803 - protein, 12 aa, Brucella spp.
GPPPRAYRGGNP

SEQ ID NO: 8804 - protein, 20 aa, Brucella spp.
YDNTYQPNYGPRRQCYSPYL

SEQ ID NO: 8805 - protein, 11 aa, Brucella spp.
GEADEKETRHR

SEQ ID NO: 8806 - protein, 8 aa, Brucella spp.
GGEYAEPP

SEQ ID NO: 8807 - protein, 10 aa, Brucella spp.
GASPDFSDTP

SEQ ID NO: 8808 - protein, 8 aa, Brucella spp.
PGETTTYG

SEQ ID NO: 8809 - protein, 17 aa, Brucella spp.
SNGKVGGFSAAGGTATK

SEQ ID NO: 8810 - protein, 9 aa, Brucella spp.
ARTTSEPDL

SEQ ID NO: 8811 - protein, 7 aa, Brucella spp.
EGQDIET

SEQ ID NO: 8812 - protein, 7 aa, Brucella spp.
HPTYDAT

SEQ ID NO: 8813 - protein, 4 aa, Brucella spp.
DGFR

SEQ ID NO: 8814 - protein, 7 aa, Brucella spp.
EAAGDAP

SEQ ID NO: 8815 - protein, 11 aa, Brucella spp.
EEHRRSSNRRI

SEQ ID NO: 8816 - protein, 7 aa, Brucella spp.
VSPGEKI

SEQ ID NO: 8817 - protein, 8 aa, Brucella spp.
DGRSYSKA

SEQ ID NO: 8818 - protein, 27 aa, Brucella spp.
DTPGYYQPGRGSLPQEGAFAWRRVKAG

SEQ ID NO: 8819 - protein, 8 aa, Brucella spp.
LAKEDPFG

SEQ ID NO: 8820 - protein, 10 aa, Brucella spp.
QFQASTRNGL

SEQ ID NO: 8821 - protein, 12 aa, Brucella spp.
SLPPHPLTAQGY

SEQ ID NO: 8822 - protein, 21 aa, Brucella spp.
PVSEGEDQRAGRWAGSEKTEC

SEQ ID NO: 8823 - protein, 9 aa, Brucella spp.
LSGELTEDQ

SEQ ID NO: 8824 - protein, 4 aa, Brucella spp.
SSRQ

SEQ ID NO: 8825 - protein, 4 aa, Brucella spp.
RTYD

SEQ ID NO: 8826 - protein, 12 aa, Brucella spp.
AAADEVTDPRPL

SEQ ID NO: 8827 - protein, 6 aa, Brucella spp.
SEHDRA

SEQ ID NO: 8828 - protein, 7 aa, Brucella spp.
KNEAGEL

SEQ ID NO: 8829 - protein, 9 aa, Brucella spp.
GGGQGRTPM

SEQ ID NO: 8830 - protein, 7 aa, Brucella spp.
GRRDNKF

SEQ ID NO: 8831 - protein, 6 aa, Brucella spp.
PQRPEG

SEQ ID NO: 8832 - protein, 6 aa, Brucella spp.
KADAEF

SEQ ID NO: 8833 - protein, 5 aa, Brucella spp.
AHKHP

SEQ ID NO: 8834 - protein, 12 aa, Brucella spp.
VGGIPGDASAEQ

SEQ ID NO: 8835 - protein, 4 aa, Brucella spp.
SGGL

SEQ ID NO: 8836 - protein, 6 aa, Brucella spp.
KKGEEL

SEQ ID NO: 8837 - protein, 12 aa, Brucella spp.
GGSADENSAIGE

SEQ ID NO: 8838 - protein, 9 aa, Brucella spp.
GPARKCGGN

SEQ ID NO: 8839 - protein, 10 aa, Brucella spp.
LSPGGNGAFQ

SEQ ID NO: 8840 - protein, 18 aa, Brucella spp.
PRKPGFSKQATAHPRRTK

SEQ ID NO: 8841 - protein, 8 aa, Brucella spp.
GGGEEALN

SEQ ID NO: 8842 - protein, 5 aa, Brucella spp.
KAEPH

SEQ ID NO: 8843 - protein, 17 aa, Brucella spp.
GDEAGDRAAAAAARARK

SEQ ID NO: 8844 - protein, 7 aa, Brucella spp.
GSQGTAP

SEQ ID NO: 8845 - protein, 5 aa, Brucella spp.
PKGLA

SEQ ID NO: 8846 - protein, 13 aa, Brucella spp.
RAVESGDHEAAHR

SEQ ID NO: 8847 - protein, 9 aa, Brucella spp.
IGQGQDASG

SEQ ID NO: 8848 - protein, 7 aa, Brucella spp.
AGPGAED

SEQ ID NO: 8849 - protein, 22 aa, Brucella spp.
RDAERLPVGKRKGCHSKSQGEI

SEQ ID NO: 8850 - protein, 6 aa, Brucella spp.
GQEGKR

SEQ ID NO: 8851 - protein, 4 aa, Brucella spp.
SGDP

SEQ ID NO: 8852 - protein, 4 aa, Brucella spp.
GEEM

SEQ ID NO: 8853 - protein, 7 aa, Brucella spp.
NASRSNK

SEQ ID NO: 8854 - protein, 12 aa, Brucella spp.
LPQLENRKELSG

SEQ ID NO: 8855 - protein, 7 aa, Brucella spp.
GAAIGRA

SEQ ID NO: 8856 - protein, 8 aa, Brucella spp.
NAAEAGPK

SEQ ID NO: 8857 - protein, 4 aa, Brucella spp.
AGKS

SEQ ID NO: 8858 - protein, 9 aa, Brucella spp.
DAGTPLVSD

SEQ ID NO: 8859 - protein, 5 aa, Brucella spp.
AREAG

SEQ ID NO: 8860 - protein, 6 aa, Brucella spp.
ASGLPT

SEQ ID NO: 8861 - protein, 11 aa, Brucella spp.
KHGQKQSRLES

SEQ ID NO: 8862 - protein, 9 aa, Brucella spp.
SPNRAAATL

SEQ ID NO: 8863 - protein, 5 aa, Brucella spp.
TGRQG

SEQ ID NO: 8864 - protein, 9 aa, Brucella spp.
TFDGEDRIR

SEQ ID NO: 8865 - protein, 14 aa, Brucella spp.
PPTGEAVAQSEEDI

SEQ ID NO: 8866 - protein, 18 aa, Brucella spp.
MPPSKAAGEAARMTGGQK

SEQ ID NO: 8867 - protein, 5 aa, Brucella spp.
AGKLR

SEQ ID NO: 8868 - protein, 13 aa, Brucella spp.
LPEPDETGTTFEE

SEQ ID NO: 8869 - protein, 15 aa, Brucella spp.
AAKATGFPALSDDSG

SEQ ID NO: 8870 - protein, 7 aa, Brucella spp.
DGEPGVY

SEQ ID NO: 8871 - protein, 9 aa, Brucella spp.
AETEDGKRD

SEQ ID NO: 8872 - protein, 12 aa, Brucella spp.
EKGATTPDKRKA

SEQ ID NO: 8873 - protein, 6 aa, Brucella spp.
DGEAEY

SEQ ID NO: 8874 - protein, 4 aa, Brucella spp.
GKTF

SEQ ID NO: 8875 - protein, 22 aa, Brucella spp.
GEMTAEEKHGWKPGDASALSHR

SEQ ID NO: 8876 - protein, 7 aa, Brucella spp.
VSKHAEG

SEQ ID NO: 8877 - protein, 4 aa, Brucella spp.
GKGW

SEQ ID NO: 8878 - protein, 23 aa, Brucella spp.
PRSTGERMRREAAAGKQGGRTQE

SEQ ID NO: 8879 - protein, 10 aa, Brucella spp.
ADGGTRTAAI

SEQ ID NO: 8880 - protein, 9 aa, Brucella spp.
EDSVAETDS

SEQ ID NO: 8881 - protein, 9 aa, Brucella spp.
GTAEGVPFS

SEQ ID NO: 8882 - protein, 6 aa, Brucella spp.
LDQRSR

SEQ ID NO: 8883 - protein, 10 aa, Brucella spp.
NDGDPVGSRN

SEQ ID NO: 8884 - protein, 5 aa, Brucella spp.
GRLPT

SEQ ID NO: 8885 - protein, 12 aa, Brucella spp.
DLPPEERSSIEA

SEQ ID NO: 8886 - protein, 11 aa, Brucella spp.
RAAGTSNSVES

SEQ ID NO: 8887 - protein, 5 aa, Brucella spp.
GLSRG

SEQ ID NO: 8888 - protein, 4 aa, Brucella spp.
GDVE

SEQ ID NO: 8889 - protein, 6 aa, Brucella spp.
AGISTS

SEQ ID NO: 8890 - protein, 19 aa, Brucella spp.
LSEAKSELRKLSEETRREL

SEQ ID NO: 8891 - protein, 8 aa, Brucella spp.
GAGADQPA

SEQ ID NO: 8892 - protein, 4 aa, Brucella spp.
QEDI

SEQ ID NO: 8893 - protein, 5 aa, Brucella spp.
ETKDG

SEQ ID NO: 8894 - protein, 5 aa, Brucella spp.
EAGSG

SEQ ID NO: 8895 - protein, 7 aa, Brucella spp.
YRDSEQR

SEQ ID NO: 8896 - protein, 21 aa, Brucella spp.
DLDQRDINNPRDREALKQAAD

SEQ ID NO: 8897 - protein, 19 aa, Brucella spp.
RRAEAAADEAEGEVDETAN

SEQ ID NO: 8898 - protein, 6 aa, Brucella spp.
DNTELK

SEQ ID NO: 8899 - protein, 12 aa, Brucella spp.
RKRTQRDVQDAR

SEQ ID NO: 8900 - protein, 20 aa, Brucella spp.
PADALEADSNLKSLSEGVEM

SEQ ID NO: 8901 - protein, 12 aa, Brucella spp.
KLEPEGQKFDPN

SEQ ID NO: 8902 - protein, 7 aa, Brucella spp.
NPDLPNN

SEQ ID NO: 8903 - protein, 20 aa, Brucella spp.
SKGGPKVSAENGASTSEDNA

SEQ ID NO: 8904 - protein, 11 aa, Brucella spp.
GSTSPVRRPRR

SEQ ID NO: 8905 - protein, 9 aa, Brucella spp.
QRPEPKGEL

SEQ ID NO: 8906 - protein, 11 aa, Brucella spp.
QATDAGVNKAT

SEQ ID NO: 8907 - protein, 5 aa, Brucella spp.
DTPQK

SEQ ID NO: 8908 - protein, 4 aa, Brucella spp.
EKVG

SEQ ID NO: 8909 - protein, 9 aa, Brucella spp.
GGEVPGDRD

SEQ ID NO: 8910 - protein, 7 aa, Brucella spp.
GVGRKTA

SEQ ID NO: 8911 - protein, 10 aa, Brucella spp.
LAPGKTPEAV

SEQ ID NO: 8912 - protein, 5 aa, Brucella spp.
RKPEC

SEQ ID NO: 8913 - protein, 7 aa, Brucella spp.
RAREEIS

SEQ ID NO: 8914 - protein, 7 aa, Brucella spp.
AASGKMT

SEQ ID NO: 8915 - protein, 5 aa, Brucella spp.
RKPDI

SEQ ID NO: 8916 - protein, 5 aa, Brucella spp.
ESREN

SEQ ID NO: 8917 - protein, 8 aa, Brucella spp.
PDERESFA

SEQ ID NO: 8918 - protein, 7 aa, Brucella spp.
GDGYPPY

SEQ ID NO: 8919 - protein, 8 aa, Brucella spp.
RGDTGSER

SEQ ID NO: 8920 - protein, 9 aa, Brucella spp.
RQTDDTERE

SEQ ID NO: 8921 - protein, 7 aa, Brucella spp.
DRPEPER

SEQ ID NO: 8922 - protein, 4 aa, Brucella spp.
SDDL

SEQ ID NO: 8923 - protein, 6 aa, Brucella spp.
SLPPIA

SEQ ID NO: 8924 - protein, 4 aa, Brucella spp.
SGEP

SEQ ID NO: 8925 - protein, 6 aa, Brucella spp.
TALQGA

SEQ ID NO: 8926 - protein, 7 aa, Brucella spp.
KASSKKQ

SEQ ID NO: 8927 - protein, 8 aa, Brucella spp.
AAELTGLP

SEQ ID NO: 8928 - protein, 10 aa, Brucella spp.
RLGSTGVGNG

SEQ ID NO: 8929 - protein, 4 aa, Brucella spp.
DDQP

SEQ ID NO: 8930 - protein, 7 aa, Brucella spp.
ENAGADH

SEQ ID NO: 8931 - protein, 6 aa, Brucella spp.
RGTHDA

SEQ ID NO: 8932 - protein, 9 aa, Brucella spp.
VAKSGSRFS

SEQ ID NO: 8933 - protein, 14 aa, Brucella spp.
GATLQSAGEAQDPQ

SEQ ID NO: 8934 - protein, 4 aa, Brucella spp.
IETR

SEQ ID NO: 8935 - protein, 10 aa, Brucella spp.
KSRAPAQQNA

SEQ ID NO: 8936 - protein, 14 aa, Brucella spp.
LPEEEEDLPADYAP

SEQ ID NO: 8937 - protein, 6 aa, Brucella spp.
AGNDEV

SEQ ID NO: 8938 - protein, 25 aa, Brucella spp.
EADSDDLAGGEPASGADDPTESANN

SEQ ID NO: 8939 - protein, 14 aa, Brucella spp.
EGAGAAENLSATFD

SEQ ID NO: 8940 - protein, 8 aa, Brucella spp.
DLGSSQEQ

SEQ ID NO: 8941 - protein, 12 aa, Brucella spp.
AGEGAFSGNGYD

SEQ ID NO: 8942 - protein, 6 aa, Brucella spp.
ALDESG

SEQ ID NO: 8943 - protein, 4 aa, Brucella spp.
DPPG

SEQ ID NO: 8944 - protein, 9 aa, Brucella spp.
LDPKPGARF

SEQ ID NO: 8945 - protein, 9 aa, Brucella spp.
SGSVKTEEK

SEQ ID NO: 8946 - protein, 4 aa, Brucella spp.
QRAR

SEQ ID NO: 8947 - protein, 4 aa, Brucella spp.
ISRV

SEQ ID NO: 8948 - protein, 14 aa, Brucella spp.
ASSEGGEAHSSESV

SEQ ID NO: 8949 - protein, 9 aa, Brucella spp.
AEKPDEVLS

SEQ ID NO: 8950 - protein, 6 aa, Brucella spp.
KDGVDI

SEQ ID NO: 8951 - protein, 16 aa, Brucella spp.
SSAQRRREKKARFSTP

SEQ ID NO: 8952 - protein, 13 aa, Brucella spp.
QNATPSGRGAGGM

SEQ ID NO: 8953 - protein, 8 aa, Brucella spp.
GASEKADS

SEQ ID NO: 8954 - protein, 7 aa, Brucella spp.
TPASPVK

SEQ ID NO: 8955 - protein, 9 aa, Brucella spp.
VNTGGETGK

SEQ ID NO: 8956 - protein, 13 aa, Brucella spp.
LNGYTKDNRPYSM

SEQ ID NO: 8957 - protein, 14 aa, Brucella spp.
AAKATQDVKNSGAI

SEQ ID NO: 8958 - protein, 25 aa, Brucella spp.
LPVGEKGHATVEAASGVYDNANGRL

SEQ ID NO: 8959 - protein, 8 aa, Brucella spp.
TVTTDNGL

SEQ ID NO: 8960 - protein, 16 aa, Brucella spp.
KSGQIATDKPVDIRNG

SEQ ID NO: 8961 - protein, 5 aa, Brucella spp.
QVKDN

SEQ ID NO: 8962 - protein, 13 aa, Brucella spp.
GNTLSANKTPEGG

SEQ ID NO: 8963 - protein, 5 aa, Brucella spp.
EFNQP

SEQ ID NO: 8964 - protein, 7 aa, Brucella spp.
IAGDDAV

SEQ ID NO: 8965 - protein, 10 aa, Brucella spp.
SPGGTTVGGE

SEQ ID NO: 8966 - protein, 7 aa, Brucella spp.
ATKKPVV

SEQ ID NO: 8967 - protein, 23 aa, Brucella spp.
TIKSSPLKAEPNYFSPASEEAKN

SEQ ID NO: 8968 - protein, 4 aa, Brucella spp.
GRQA

SEQ ID NO: 8969 - protein, 7 aa, Brucella spp.
GLGGEAE

SEQ ID NO: 8970 - protein, 6 aa, Brucella spp.
GLSDKL

SEQ ID NO: 8971 - protein, 7 aa, Brucella spp.
VGSETGF

SEQ ID NO: 8972 - protein, 10 aa, Brucella spp.
PQEADGAIKE

SEQ ID NO: 8973 - protein, 6 aa, Brucella spp.
LAEGNR

SEQ ID NO: 8974 - protein, 18 aa, Brucella spp.
KNRPARSGRNPRTGETVD

SEQ ID NO: 8975 - protein, 57 aa, Brucella spp.
SGGKQERGFERRKQDAPRTENKFESRTEGKGAFKKPRPQFAKAAPKPAEEKAPGPLR

SEQ ID NO: 8976 - protein, 10 aa, Brucella spp.
PYTGPRPAER

SEQ ID NO: 8977 - protein, 7 aa, Brucella spp.
TEPSPDY

SEQ ID NO: 8978 - protein, 5 aa, Brucella spp.
SGNGL

SEQ ID NO: 8979 - protein, 5 aa, Brucella spp.
QREWD

SEQ ID NO: 8980 - protein, 9 aa, Brucella spp.
TGNTDEEGM

SEQ ID NO: 8981 - protein, 7 aa, Brucella spp.
KTPLGET

SEQ ID NO: 8982 - protein, 8 aa, Brucella spp.
VKTGARSR

SEQ ID NO: 8983 - protein, 15 aa, Brucella spp.
GSRPEHRPEHPKVGQ

SEQ ID NO: 8984 - protein, 11 aa, Brucella spp.
KSGKGNKTVEQ

SEQ ID NO: 8985 - protein, 7 aa, Brucella spp.
TRRDNPQ

SEQ ID NO: 8986 - protein, 7 aa, Brucella spp.
LKPKGND

SEQ ID NO: 8987 - protein, 7 aa, Brucella spp.
VRDPGNL

SEQ ID NO: 8988 - protein, 5 aa, Brucella spp.
DAVGA

SEQ ID NO: 8989 - protein, 7 aa, Brucella spp.
TTDPYSL

SEQ ID NO: 8990 - protein, 10 aa, Brucella spp.
EQQGLPDSLA

SEQ ID NO: 8991 - protein, 9 aa, Brucella spp.
IPQAGRADS

SEQ ID NO: 8992 - protein, 4 aa, Brucella spp.
ASNG

SEQ ID NO: 8993 - protein, 6 aa, Brucella spp.
RAAIEA

SEQ ID NO: 8994 - protein, 16 aa, Brucella spp.
ARKETIEAVEQRDADR

SEQ ID NO: 8995 - protein, 7 aa, Brucella spp.
NEQAEKA

SEQ ID NO: 8996 - protein, 8 aa, Brucella spp.
KPEYRSKR

SEQ ID NO: 8997 - protein, 4 aa, Brucella spp.
ATDD

SEQ ID NO: 8998 - protein, 12 aa, Brucella spp.
LADTADESYTSL

SEQ ID NO: 8999 - protein, 9 aa, Brucella spp.
LASGRANAE

SEQ ID NO: 9000 - protein, 6 aa, Brucella spp.
DGGGTL

SEQ ID NO: 9001 - protein, 13 aa, Brucella spp.
RAYPTRNPSKAEN

SEQ ID NO: 9002 - protein, 12 aa, Brucella spp.
GYGRGGLAQGSD

SEQ ID NO: 9003 - protein, 6 aa, Brucella spp.
QTPWGE

SEQ ID NO: 9004 - protein, 6 aa, Brucella spp.
GHSTRN

SEQ ID NO: 9005 - protein, 7 aa, Brucella spp.
KGTEPEF

SEQ ID NO: 9006 - protein, 14 aa, Brucella spp.
AERDARHRKAGETR

SEQ ID NO: 9007 - protein, 11 aa, Brucella spp.
NVKEGKGGQRD

SEQ ID NO: 9008 - protein, 7 aa, Brucella spp.
TAHPGQN

SEQ ID NO: 9009 - protein, 8 aa, Brucella spp.
EQQAKHVP

SEQ ID NO: 9010 - protein, 9 aa, Brucella spp.
KRKLSDDGA

SEQ ID NO: 9011 - protein, 7 aa, Brucella spp.
LRENPEA

SEQ ID NO: 9012 - protein, 5 aa, Brucella spp.
SPRNP

SEQ ID NO: 9013 - protein, 6 aa, Brucella spp.
KTEHPL

SEQ ID NO: 9014 - protein, 9 aa, Brucella spp.
KGRPEDHSI

SEQ ID NO: 9015 - protein, 7 aa, Brucella spp.
TPSETET

SEQ ID NO: 9016 - protein, 7 aa, Brucella spp.
SRDLNDR

SEQ ID NO: 9017 - protein, 14 aa, Brucella spp.
LSRAARDKQAREAL

SEQ ID NO: 9018 - protein, 8 aa, Brucella spp.
DWPKEERD

SEQ ID NO: 9019 - protein, 7 aa, Brucella spp.
ADQQGRA

SEQ ID NO: 9020 - protein, 6 aa, Brucella spp.
AAGGNI

SEQ ID NO: 9021 - protein, 8 aa, Brucella spp.
TTSDGRAL

SEQ ID NO: 9022 - protein, 14 aa, Brucella spp.
FDTDDDERRRAERV

SEQ ID NO: 9023 - protein, 12 aa, Brucella spp.
KRTKPKKAARAF

SEQ ID NO: 9024 - protein, 9 aa, Brucella spp.
SNATRQGNI

SEQ ID NO: 9025 - protein, 15 aa, Brucella spp.
ENGARTNGRSPQAAA

SEQ ID NO: 9026 - protein, 6 aa, Brucella spp.
GTGPVA

SEQ ID NO: 9027 - protein, 11 aa, Brucella spp.
EKNGMDGARRF

SEQ ID NO: 9028 - protein, 6 aa, Brucella spp.
GFTDDP

SEQ ID NO: 9029 - protein, 5 aa, Brucella spp.
RLTPN

SEQ ID NO: 9030 - protein, 5 aa, Brucella spp.
SGMQG

SEQ ID NO: 9031 - protein, 5 aa, Brucella spp.
RGGHM

SEQ ID NO: 9032 - protein, 9 aa, Brucella spp.
KEASNLQNR

SEQ ID NO: 9033 - protein, 7 aa, Brucella spp.
KFSPDST

SEQ ID NO: 9034 - protein, 5 aa, Brucella spp.
EDTRT

SEQ ID NO: 9035 - protein, 9 aa, Brucella spp.
AAPLAARAG

SEQ ID NO: 9036 - protein, 7 aa, Brucella spp.
GGANTGM

SEQ ID NO: 9037 - protein, 13 aa, Brucella spp.
KRGGGKNQPKSEA

SEQ ID NO: 9038 - protein, 9 aa, Brucella spp.
GCSTAGGSF

SEQ ID NO: 9039 - protein, 9 aa, Brucella spp.
YSSVSDAGY

SEQ ID NO: 9040 - protein, 11 aa, Brucella spp.
AIPSEKIPAQY

SEQ ID NO: 9041 - protein, 8 aa, Brucella spp.
ATDEKPGT

SEQ ID NO: 9042 - protein, 6 aa, Brucella spp.
TWTPPS

SEQ ID NO: 9043 - protein, 5 aa, Brucella spp.
QPELA

SEQ ID NO: 9044 - protein, 12 aa, Brucella spp.
NGMDPGLRNPLG

SEQ ID NO: 9045 - protein, 8 aa, Brucella spp.
KGGDTGYR

SEQ ID NO: 9046 - protein, 4 aa, Brucella spp.
GTQG

SEQ ID NO: 9047 - protein, 8 aa, Brucella spp.
PQAKDGPV

SEQ ID NO: 9048 - protein, 6 aa, Brucella spp.
KGEYRQ

SEQ ID NO: 9049 - protein, 16 aa, Brucella spp.
DTSPRGDSIADEPDNW

SEQ ID NO: 9050 - protein, 7 aa, Brucella spp.
GHSMGGH

SEQ ID NO: 9051 - protein, 6 aa, Brucella spp.
NPDRFK

SEQ ID NO: 9052 - protein, 10 aa, Brucella spp.
QPSTAGWSRP

SEQ ID NO: 9053 - protein, 7 aa, Brucella spp.
LGPDEQA

SEQ ID NO: 9054 - protein, 7 aa, Brucella spp.
QGTADGF

SEQ ID NO: 9055 - protein, 7 aa, Brucella spp.
PAEYGAD

SEQ ID NO: 9056 - protein, 5 aa, Brucella spp.
VRKRP

SEQ ID NO: 9057 - protein, 7 aa, Brucella spp.
DTDDGSG

SEQ ID NO: 9058 - protein, 17 aa, Brucella spp.
ADGSCTVTDNGRGIPTD

SEQ ID NO: 9059 - protein, 7 aa, Brucella spp.
KEEGVSA

SEQ ID NO: 9060 - protein, 15 aa, Brucella spp.
GGKFDQNSYKVSGGL

SEQ ID NO: 9061 - protein, 10 aa, Brucella spp.
GDAGSETGTE

SEQ ID NO: 9062 - protein, 5 aa, Brucella spp.
PSPDT

SEQ ID NO: 9063 - protein, 11 aa, Brucella spp.
RRHADVKEQEL

SEQ ID NO: 9064 - protein, 9 aa, Brucella spp.
TDQSKKSLL

SEQ ID NO: 9065 - protein, 6 aa, Brucella spp.
EKDGMT

SEQ ID NO: 9066 - protein, 9 aa, Brucella spp.
IPQRDGGTH

SEQ ID NO: 9067 - protein, 26 aa, Brucella spp.
ITGYADSSGMTKKEKVQLTGDDCREG

SEQ ID NO: 9068 - protein, 18 aa, Brucella spp.
VPDPKFSSQTKDKLVSSE

SEQ ID NO: 9069 - protein, 6 aa, Brucella spp.
HPAGGK

SEQ ID NO: 9070 - protein, 27 aa, Brucella spp.
AAAREAARKARDITRKSNLSVTSLPGK

SEQ ID NO: 9071 - protein, 9 aa, Brucella spp.
CQERDPAKS

SEQ ID NO: 9072 - protein, 16 aa, Brucella spp.
DSAGGSAKSGRSRQNQ

SEQ ID NO: 9073 - protein, 12 aa, Brucella spp.
TSIGKDETHGFN

SEQ ID NO: 9074 - protein, 4 aa, Brucella spp.
VDGA

SEQ ID NO: 9075 - protein, 11 aa, Brucella spp.
TRGKSSQYIKN

SEQ ID NO: 9076 - protein, 4 aa, Brucella spp.
LEET

SEQ ID NO: 9077 - protein, 7 aa, Brucella spp.
MRAGPDL

SEQ ID NO: 9078 - protein, 18 aa, Brucella spp.
NPDASRDNATAQHSADTV

SEQ ID NO: 9079 - protein, 7 aa, Brucella spp.
EETERGW

SEQ ID NO: 9080 - protein, 8 aa, Brucella spp.
SADARQVD

SEQ ID NO: 9081 - protein, 10 aa, Brucella spp.
KDKVESLSGP

SEQ ID NO: 9082 - protein, 5 aa, Brucella spp.
TGRKG

SEQ ID NO: 9083 - protein, 4 aa, Brucella spp.
LGEM

SEQ ID NO: 9084 - protein, 8 aa, Brucella spp.
NDATDADS

SEQ ID NO: 9085 - protein, 5 aa, Brucella spp.
EVEPR

SEQ ID NO: 9086 - protein, 12 aa, Brucella spp.
PPLTRKTDGLPV

SEQ ID NO: 9087 - protein, 7 aa, Brucella spp.
DARNTDV

SEQ ID NO: 9088 - protein, 14 aa, Brucella spp.
PDYKANRTAPPEDL

SEQ ID NO: 9089 - protein, 5 aa, Brucella spp.
EGFEA

SEQ ID NO: 9090 - protein, 8 aa, Brucella spp.
AEKAGGDV

SEQ ID NO: 9091 - protein, 5 aa, Brucella spp.
DKQIS

SEQ ID NO: 9092 - protein, 4 aa, Brucella spp.
VPPE

SEQ ID NO: 9093 - protein, 21 aa, Brucella spp.
LTGDSTDNVPGIPGIGPKTAA

SEQ ID NO: 9094 - protein, 10 aa, Brucella spp.
SEIKQNKRRE

SEQ ID NO: 9095 - protein, 7 aa, Brucella spp.
EPQNGPK

SEQ ID NO: 9096 - protein, 13 aa, Brucella spp.
VAEATDTDASSVE

SEQ ID NO: 9097 - protein, 20 aa, Brucella spp.
ADAHGPDVDVPEKADAAASQ

SEQ ID NO: 9098 - protein, 25 aa, Brucella spp.
SAPTAAEPDQGYTPKALAEGRAAQA

SEQ ID NO: 9099 - protein, 4 aa, Brucella spp.
KIDT

SEQ ID NO: 9100 - protein, 9 aa, Brucella spp.
TETTSLDPM

SEQ ID NO: 9101 - protein, 6 aa, Brucella spp.
APGKAA

SEQ ID NO: 9102 - protein, 9 aa, Brucella spp.
HKSGAGDLL

SEQ ID NO: 9103 - protein, 10 aa, Brucella spp.
AGTGSHGMDP

SEQ ID NO: 9104 - protein, 10 aa, Brucella spp.
DVAGSGKSAV

SEQ ID NO: 9105 - protein, 9 aa, Brucella spp.
TAYAAEDAD

SEQ ID NO: 9106 - protein, 11 aa, Brucella spp.
GDLAQAAAAYE

SEQ ID NO: 9107 - protein, 8 aa, Brucella spp.
TIGSPKQL

SEQ ID NO: 9108 - protein, 16 aa, Brucella spp.
LPGASKTKTGQWSTSA

SEQ ID NO: 9109 - protein, 7 aa, Brucella spp.
AEGHPLP

SEQ ID NO: 9110 - protein, 7 aa, Brucella spp.
KSTYTDA

SEQ ID NO: 9111 - protein, 5 aa, Brucella spp.
TKRVH

SEQ ID NO: 9112 - protein, 16 aa, Brucella spp.
ASTSTGRLSSSDPNLQ

SEQ ID NO: 9113 - protein, 8 aa, Brucella spp.
RTAEGRKI

SEQ ID NO: 9114 - protein, 5 aa, Brucella spp.
EPGNK

SEQ ID NO: 9115 - protein, 8 aa, Brucella spp.
MPSEVRRR

SEQ ID NO: 9116 - protein, 8 aa, Brucella spp.
IPREEAGQ

SEQ ID NO: 9117 - protein, 8 aa, Brucella spp.
RASNPQVR

SEQ ID NO: 9118 - protein, 7 aa, Brucella spp.
NAPIQGA

SEQ ID NO: 9119 - protein, 4 aa, Brucella spp.
AKEN

SEQ ID NO: 9120 - protein, 6 aa, Brucella spp.
NEVEKT

SEQ ID NO: 9121 - protein, 11 aa, Brucella spp.
ISTDPAYKADC

SEQ ID NO: 9122 - protein, 7 aa, Brucella spp.
VRDTPGH

SEQ ID NO: 9123 - protein, 7 aa, Brucella spp.
DGATADA

SEQ ID NO: 9124 - protein, 5 aa, Brucella spp.
PFDPA

SEQ ID NO: 9125 - protein, 11 aa, Brucella spp.
VGDASNGGRKI

SEQ ID NO: 9126 - protein, 11 aa, Brucella spp.
TGRGTSDDKGQ

SEQ ID NO: 9127 - protein, 5 aa, Brucella spp.
VNGSL

SEQ ID NO: 9128 - protein, 11 aa, Brucella spp.
GEEESGSPSLK

SEQ ID NO: 9129 - protein, 5 aa, Brucella spp.
RQELK

SEQ ID NO: 9130 - protein, 5 aa, Brucella spp.
ETPAI

SEQ ID NO: 9131 - protein, 4 aa, Brucella spp.
DRDL

SEQ ID NO: 9132 - protein, 5 aa, Brucella spp.
DETGR

SEQ ID NO: 9133 - protein, 7 aa, Brucella spp.
VEETPTQ

SEQ ID NO: 9134 - protein, 6 aa, Brucella spp.
SLGRTA

SEQ ID NO: 9135 - protein, 9 aa, Brucella spp.
IPAGEKGRS

SEQ ID NO: 9136 - protein, 5 aa, Brucella spp.
RPTAE

SEQ ID NO: 9137 - protein, 6 aa, Brucella spp.
GYTGEG

SEQ ID NO: 9138 - protein, 5 aa, Brucella spp.
EASAK

SEQ ID NO: 9139 - protein, 4 aa, Brucella spp.
DPVK

SEQ ID NO: 9140 - protein, 9 aa, Brucella spp.
PHGGSPAIQ

SEQ ID NO: 9141 - protein, 4 aa, Brucella spp.
SPLV

SEQ ID NO: 9142 - protein, 13 aa, Brucella spp.
SKAKNALSDEWPK

SEQ ID NO: 9143 - protein, 9 aa, Brucella spp.
RIHSPNEKY

SEQ ID NO: 9144 - protein, 5 aa, Brucella spp.
KGQRS

SEQ ID NO: 9145 - protein, 4 aa, Brucella spp.
LNPH

SEQ ID NO: 9146 - protein, 8 aa, Brucella spp.
SPGDGTAD

SEQ ID NO: 9147 - protein, 9 aa, Brucella spp.
AGQKKAPNL

SEQ ID NO: 9148 - protein, 8 aa, Brucella spp.
LTRTYTDR

SEQ ID NO: 9149 - protein, 9 aa, Brucella spp.
SKQQQSSDW

SEQ ID NO: 9150 - protein, 11 aa, Brucella spp.
LERDGRTKQAE

SEQ ID NO: 9151 - protein, 9 aa, Brucella spp.
GDKGGNPAG

SEQ ID NO: 9152 - protein, 8 aa, Brucella spp.
LPSPQDMQ

SEQ ID NO: 9153 - protein, 8 aa, Brucella spp.
FAAPDGES

SEQ ID NO: 9154 - protein, 5 aa, Brucella spp.
REGDG

SEQ ID NO: 9155 - protein, 9 aa, Brucella spp.
SVEGRKEGE

SEQ ID NO: 9156 - protein, 17 aa, Brucella spp.
LQSPRTRNRAATEAEIG

SEQ ID NO: 9157 - protein, 4 aa, Brucella spp.
TPRR

SEQ ID NO: 9158 - protein, 18 aa, Brucella spp.
PFASGGVYEDPATGAATA

SEQ ID NO: 9159 - protein, 8 aa, Brucella spp.
EDMGSPSH

SEQ ID NO: 9160 - protein, 19 aa, Brucella spp.
IGTERGGSIRVSGTARLME

SEQ ID NO: 9161 - protein, 7 aa, Brucella spp.
EIDEGEL

SEQ ID NO: 9162 - protein, 6 aa, Brucella spp.
RKDGQY

SEQ ID NO: 9163 - protein, 5 aa, Brucella spp.
FGTRR

SEQ ID NO: 9164 - protein, 10 aa, Brucella spp.
EGIGSAFTGT

SEQ ID NO: 9165 - protein, 6 aa, Brucella spp.
ALGTNA

SEQ ID NO: 9166 - protein, 10 aa, Brucella spp.
KTDDELRSAP

SEQ ID NO: 9167 - protein, 12 aa, Brucella spp.
FRPDSAPPIEGG

SEQ ID NO: 9168 - protein, 7 aa, Brucella spp.
KGKDPRE

SEQ ID NO: 9169 - protein, 7 aa, Brucella spp.
APQSIDG

SEQ ID NO: 9170 - protein, 7 aa, Brucella spp.
DANGHPA

SEQ ID NO: 9171 - protein, 15 aa, Brucella spp.
LSDNPQKATGDPKEV

SEQ ID NO: 9172 - protein, 19 aa, Brucella spp.
STEHKTSEQIPPEQPSPIR

SEQ ID NO: 9173 - protein, 5 aa, Brucella spp.
KTEEE

SEQ ID NO: 9174 - protein, 8 aa, Brucella spp.
ARGEDIPL

SEQ ID NO: 9175 - protein, 5 aa, Brucella spp.
LSENG

SEQ ID NO: 9176 - protein, 14 aa, Brucella spp.
ASDAASRAGETITP

SEQ ID NO: 9177 - protein, 9 aa, Brucella spp.
NVQQARRDL

SEQ ID NO: 9178 - protein, 4 aa, Brucella spp.
NTAA

SEQ ID NO: 9179 - protein, 4 aa, Brucella spp.
GAEL

SEQ ID NO: 9180 - protein, 4 aa, Brucella spp.
CDST

SEQ ID NO: 9181 - protein, 10 aa, Brucella spp.
SSSTDTTAAA

SEQ ID NO: 9182 - protein, 9 aa, Brucella spp.
QDGSNPEDA

SEQ ID NO: 9183 - protein, 9 aa, Brucella spp.
ARQSTGGVT

SEQ ID NO: 9184 - protein, 20 aa, Brucella spp.
AEDGSRAEKAGHPQAEGKGA

SEQ ID NO: 9185 - protein, 7 aa, Brucella spp.
GEGRRDL

SEQ ID NO: 9186 - protein, 8 aa, Brucella spp.
DGLPPEAR

SEQ ID NO: 9187 - protein, 6 aa, Brucella spp.
DSIDEQ

SEQ ID NO: 9188 - protein, 4 aa, Brucella spp.
NPRG

SEQ ID NO: 9189 - protein, 7 aa, Brucella spp.
TDASQEI

SEQ ID NO: 9190 - protein, 9 aa, Brucella spp.
EHYTGDDQP

SEQ ID NO: 9191 - protein, 4 aa, Brucella spp.
RGKL

SEQ ID NO: 9192 - protein, 7 aa, Brucella spp.
GDQDTSF

SEQ ID NO: 9193 - protein, 5 aa, Brucella spp.
ERLPK

SEQ ID NO: 9194 - protein, 6 aa, Brucella spp.
TRLTPE

SEQ ID NO: 9195 - protein, 8 aa, Brucella spp.
DEKTGKVV

SEQ ID NO: 9196 - protein, 11 aa, Brucella spp.
VTPSLTTGDEA

SEQ ID NO: 9197 - protein, 8 aa, Brucella spp.
EGTFTGKG

SEQ ID NO: 9198 - protein, 7 aa, Brucella spp.
GRVPENT

SEQ ID NO: 9199 - protein, 5 aa, Brucella spp.
GGYAR

SEQ ID NO: 9200 - protein, 6 aa, Brucella spp.
DYPTGY

SEQ ID NO: 9201 - protein, 4 aa, Brucella spp.
RGVS

SEQ ID NO: 9202 - protein, 4 aa, Brucella spp.
HAQS

SEQ ID NO: 9203 - protein, 8 aa, Brucella spp.
AQARTSPD

SEQ ID NO: 9204 - protein, 8 aa, Brucella spp.
SAKPQDTL

SEQ ID NO: 9205 - protein, 9 aa, Brucella spp.
SSDKADLRR

SEQ ID NO: 9206 - protein, 18 aa, Brucella spp.
NEENNHLPPDNFQEDPAP

SEQ ID NO: 9207 - protein, 7 aa, Brucella spp.
QRTSPTN

SEQ ID NO: 9208 - protein, 5 aa, Brucella spp.
DSGNL

SEQ ID NO: 9209 - protein, 4 aa, Brucella spp.
IPDD

SEQ ID NO: 9210 - protein, 10 aa, Brucella spp.
SIKDEPETDH

SEQ ID NO: 9211 - protein, 13 aa, Brucella spp.
SEVETVASAEARE

SEQ ID NO: 9212 - protein, 26 aa, Brucella spp.
KAHTDDAIGEHDTDALRDGLPDLATR

SEQ ID NO: 9213 - protein, 6 aa, Brucella spp.
ENELDE

SEQ ID NO: 9214 - protein, 6 aa, Brucella spp.
YATSRG

SEQ ID NO: 9215 - protein, 4 aa, Brucella spp.
FNAR

SEQ ID NO: 9216 - protein, 6 aa, Brucella spp.
YQPAAA

SEQ ID NO: 9217 - protein, 10 aa, Brucella spp.
TPSRIREGET

SEQ ID NO: 9218 - protein, 5 aa, Brucella spp.
KAPRE

SEQ ID NO: 9219 - protein, 15 aa, Brucella spp.
TENPMRVDSGGFDDA

SEQ ID NO: 9220 - protein, 6 aa, Brucella spp.
FRAPRT

SEQ ID NO: 9221 - protein, 6 aa, Brucella spp.
NGSGYS

SEQ ID NO: 9222 - protein, 7 aa, Brucella spp.
DASEDMQ

SEQ ID NO: 9223 - protein, 17 aa, Brucella spp.
TGEPVRNPDEETKTVFT

SEQ ID NO: 9224 - protein, 4 aa, Brucella spp.
FYKT

SEQ ID NO: 9225 - protein, 8 aa, Brucella spp.
EADGEGRR

SEQ ID NO: 9226 - protein, 7 aa, Brucella spp.
NTSPRDR

SEQ ID NO: 9227 - protein, 9 aa, Brucella spp.
DSDSDAAHP

SEQ ID NO: 9228 - protein, 9 aa, Brucella spp.
IADSGSTIY

SEQ ID NO: 9229 - protein, 10 aa, Brucella spp.
RKRAPSDPDI

SEQ ID NO: 9230 - protein, 4 aa, Brucella spp.
RSLR

SEQ ID NO: 9231 - protein, 13 aa, Brucella spp.
AAFDPGAKFTGSQ

SEQ ID NO: 9232 - protein, 6 aa, Brucella spp.
GSRDAV

SEQ ID NO: 9233 - protein, 8 aa, Brucella spp.
PAEAADYQ

SEQ ID NO: 9234 - protein, 16 aa, Brucella spp.
LRQPPETIASGLGKQS

SEQ ID NO: 9235 - protein, 7 aa, Brucella spp.
YAQDTQR

SEQ ID NO: 9236 - protein, 7 aa, Brucella spp.
ARGGGQP

SEQ ID NO: 9237 - protein, 7 aa, Brucella spp.
QMSEESY

SEQ ID NO: 9238 - protein, 13 aa, Brucella spp.
NGSLAEQLRRSEE

SEQ ID NO: 9239 - protein, 20 aa, Brucella spp.
ARSDARTATNGQASVQGLGA

SEQ ID NO: 9240 - protein, 9 aa, Brucella spp.
RGAEERRPV

SEQ ID NO: 9241 - protein, 13 aa, Brucella spp.
KPPVDRPRPSGDD

SEQ ID NO: 9242 - protein, 6 aa, Brucella spp.
GFAEDG

SEQ ID NO: 9243 - protein, 7 aa, Brucella spp.
GRTSTPH

SEQ ID NO: 9244 - protein, 4 aa, Brucella spp.
EGSA

SEQ ID NO: 9245 - protein, 7 aa, Brucella spp.
GNSRDYQ

SEQ ID NO: 9246 - protein, 10 aa, Brucella spp.
NDPVTNRPGE

SEQ ID NO: 9247 - protein, 10 aa, Brucella spp.
ETGRSFAPTA

SEQ ID NO: 9248 - protein, 6 aa, Brucella spp.
RHGHGY

SEQ ID NO: 9249 - protein, 5 aa, Brucella spp.
SAQHG

SEQ ID NO: 9250 - protein, 9 aa, Brucella spp.
TNKGRSKRK

SEQ ID NO: 9251 - protein, 5 aa, Brucella spp.
QDEEL

SEQ ID NO: 9252 - protein, 10 aa, Brucella spp.
NPYHPDKSGQ

SEQ ID NO: 9253 - protein, 14 aa, Brucella spp.
SEKPQSVTADRGEF

SEQ ID NO: 9254 - protein, 7 aa, Brucella spp.
AGSVDRP

SEQ ID NO: 9255 - protein, 11 aa, Brucella spp.
SGTVEAGRDPC

SEQ ID NO: 9256 - protein, 6 aa, Brucella spp.
VGPGEA

SEQ ID NO: 9257 - protein, 8 aa, Brucella spp.
TADQKQAK

SEQ ID NO: 9258 - protein, 6 aa, Brucella spp.
KTPDPA

SEQ ID NO: 9259 - protein, 6 aa, Brucella spp.
RQFREG

SEQ ID NO: 9260 - protein, 4 aa, Brucella spp.
GAGV

SEQ ID NO: 9261 - protein, 8 aa, Brucella spp.
ETTGDRSI

SEQ ID NO: 9262 - protein, 7 aa, Brucella spp.
KLEEGEH

SEQ ID NO: 9263 - protein, 8 aa, Brucella spp.
EISKETAS

SEQ ID NO: 9264 - protein, 5 aa, Brucella spp.
RTGKH

SEQ ID NO: 9265 - protein, 6 aa, Brucella spp.
KGKGES

SEQ ID NO: 9266 - protein, 9 aa, Brucella spp.
ARKDQKRAD

SEQ ID NO: 9267 - protein, 7 aa, Brucella spp.
DRDGWDG

SEQ ID NO: 9268 - protein, 14 aa, Brucella spp.
NGRPLGSKNSDECQ

SEQ ID NO: 9269 - protein, 12 aa, Brucella spp.
VADPKRAKKAMA

SEQ ID NO: 9270 - protein, 8 aa, Brucella spp.
VTPQEPGY

SEQ ID NO: 9271 - protein, 16 aa, Brucella spp.
GYPPGVRENGGQYTHG

SEQ ID NO: 9272 - protein, 7 aa, Brucella spp.
SHGRNPD

SEQ ID NO: 9273 - protein, 6 aa, Brucella spp.
PRCGQG

SEQ ID NO: 9274 - protein, 6 aa, Brucella spp.
TKRGDR

SEQ ID NO: 9275 - protein, 5 aa, Brucella spp.
PPEWE

SEQ ID NO: 9276 - protein, 9 aa, Brucella spp.
GAKAGTIRL

SEQ ID NO: 9277 - protein, 26 aa, Brucella spp.
KLAKPDEGVALKPDGEHEIVVELPKQ

SEQ ID NO: 9278 - protein, 9 aa, Brucella spp.
GPSGSGKTT

SEQ ID NO: 9279 - protein, 5 aa, Brucella spp.
ETPTE

SEQ ID NO: 9280 - protein, 11 aa, Brucella spp.
EDASQKSVQER

SEQ ID NO: 9281 - protein, 12 aa, Brucella spp.
RPGGTRPSTAEI

SEQ ID NO: 9282 - protein, 14 aa, Brucella spp.
KRYPAQLSGGQRQR

SEQ ID NO: 9283 - protein, 6 aa, Brucella spp.
DKTGHT

SEQ ID NO: 9284 - protein, 5 aa, Brucella spp.
QDEAL

SEQ ID NO: 9285 - protein, 17 aa, Brucella spp.
IEQVGTPDEVYDKPNSP

SEQ ID NO: 9286 - protein, 6 aa, Brucella spp.
SSTLPV

SEQ ID NO: 9287 - protein, 8 aa, Brucella spp.
AENMPDGD

SEQ ID NO: 9288 - protein, 9 aa, Brucella spp.
SRRSGGKRR

SEQ ID NO: 9289 - protein, 5 aa, Brucella spp.
GGARE

SEQ ID NO: 9290 - protein, 9 aa, Brucella spp.
EHPAAEKSR

SEQ ID NO: 9291 - protein, 13 aa, Brucella spp.
DSELPAPKAAATT

SEQ ID NO: 9292 - protein, 18 aa, Brucella spp.
NASEKAQLERLDPATRLE

SEQ ID NO: 9293 - protein, 17 aa, Brucella spp.
DPVTKKNTIRADGAAFR

SEQ ID NO: 9294 - protein, 7 aa, Brucella spp.
CKTDDEH

SEQ ID NO: 9295 - protein, 16 aa, Brucella spp.
GSEVPQDQWDKHYLVP

SEQ ID NO: 9296 - protein, 6 aa, Brucella spp.
GRNMAG

SEQ ID NO: 9297 - protein, 7 aa, Brucella spp.
MKDEDFG

SEQ ID NO: 9298 - protein, 9 aa, Brucella spp.
IESAGGVAK

SEQ ID NO: 9299 - protein, 5 aa, Brucella spp.
GPMEA

SEQ ID NO: 9300 - protein, 8 aa, Brucella spp.
DDHYTDEQ

SEQ ID NO: 9301 - protein, 4 aa, Brucella spp.
CPTC

SEQ ID NO: 9302 - protein, 14 aa, Brucella spp.
SLPGNGSTLATHAD

SEQ ID NO: 9303 - protein, 10 aa, Brucella spp.
YEQDDESVLP

SEQ ID NO: 9304 - protein, 5 aa, Brucella spp.
GGSTN

SEQ ID NO: 9305 - protein, 4 aa, Brucella spp.
QEAE

SEQ ID NO: 9306 - protein, 5 aa, Brucella spp.
RTNSE

SEQ ID NO: 9307 - protein, 9 aa, Brucella spp.
AAPGGVPTQ

SEQ ID NO: 9308 - protein, 10 aa, Brucella spp.
KVDTDREKGV

SEQ ID NO: 9309 - protein, 6 aa, Brucella spp.
AFSQDG

SEQ ID NO: 9310 - protein, 5 aa, Brucella spp.
AGVDD

SEQ ID NO: 9311 - protein, 5 aa, Brucella spp.
KIKPG

SEQ ID NO: 9312 - protein, 8 aa, Brucella spp.
GPRGGPGM

SEQ ID NO: 9313 - protein, 6 aa, Brucella spp.
KSKGLG

SEQ ID NO: 9314 - protein, 10 aa, Brucella spp.
RFSGGSSGLS

SEQ ID NO: 9315 - protein, 10 aa, Brucella spp.
SPEAAEGGTI

SEQ ID NO: 9316 - protein, 27 aa, Brucella spp.
TLAERRAEQDAAGWKPAEERKRKISTA

SEQ ID NO: 9317 - protein, 14 aa, Brucella spp.
ATSAARGAVRKLPD

SEQ ID NO: 9318 - protein, 8 aa, Brucella spp.
DDYQQGST

SEQ ID NO: 9319 - protein, 10 aa, Brucella spp.
MDDPARSAKP

SEQ ID NO: 9320 - protein, 6 aa, Brucella spp.
GPTIDG

SEQ ID NO: 9321 - protein, 17 aa, Brucella spp.
ARNVDRNRAGQVEEGAL

SEQ ID NO: 9322 - protein, 5 aa, Brucella spp.
AGGGA

SEQ ID NO: 9323 - protein, 7 aa, Brucella spp.
ADREDGS

SEQ ID NO: 9324 - protein, 4 aa, Brucella spp.
AIGA

SEQ ID NO: 9325 - protein, 6 aa, Brucella spp.
SYGATD

SEQ ID NO: 9326 - protein, 5 aa, Brucella spp.
RGGET

SEQ ID NO: 9327 - protein, 10 aa, Brucella spp.
TGPNGSGKST

SEQ ID NO: 9328 - protein, 13 aa, Brucella spp.
PEAGEVKLTEGTQ

SEQ ID NO: 9329 - protein, 5 aa, Brucella spp.
GGEAL

SEQ ID NO: 9330 - protein, 7 aa, Brucella spp.
TGQKRRV

SEQ ID NO: 9331 - protein, 12 aa, Brucella spp.
PTAGLDKASEAR

SEQ ID NO: 9332 - protein, 8 aa, Brucella spp.
AISTTGNG

SEQ ID NO: 9333 - protein, 6 aa, Brucella spp.
LSVGGK

SEQ ID NO: 9334 - protein, 9 aa, Brucella spp.
EAEKNGLAG

SEQ ID NO: 9335 - protein, 12 aa, Brucella spp.
DDRSVKKSDIEN

SEQ ID NO: 9336 - protein, 10 aa, Brucella spp.
DRGKAGAEIA

SEQ ID NO: 9337 - protein, 10 aa, Brucella spp.
ALGGDPEKIN

SEQ ID NO: 9338 - protein, 7 aa, Brucella spp.
YQRNGER

SEQ ID NO: 9339 - protein, 4 aa, Brucella spp.
PPGT

SEQ ID NO: 9340 - protein, 7 aa, Brucella spp.
KEEDGVT

SEQ ID NO: 9341 - protein, 8 aa, Brucella spp.
VGTDSHTT

SEQ ID NO: 9342 - protein, 7 aa, Brucella spp.
LKEGVTA

SEQ ID NO: 9343 - protein, 11 aa, Brucella spp.
ATIGNMGPEYG

SEQ ID NO: 9344 - protein, 5 aa, Brucella spp.
GRDEH

SEQ ID NO: 9345 - protein, 9 aa, Brucella spp.
RDSSSADPV

SEQ ID NO: 9346 - protein, 12 aa, Brucella spp.
SMAGPKRPEGRI

SEQ ID NO: 9347 - protein, 4 aa, Brucella spp.
SGFA

SEQ ID NO: 9348 - protein, 22 aa, Brucella spp.
TSLETEYKKTTGQTTRYPVEGE

SEQ ID NO: 9349 - protein, 8 aa, Brucella spp.
CTNTSNPS

SEQ ID NO: 9350 - protein, 9 aa, Brucella spp.
AKGLKTKPW

SEQ ID NO: 9351 - protein, 7 aa, Brucella spp.
SLAPGSQ

SEQ ID NO: 9352 - protein, 6 aa, Brucella spp.
AGLQKD

SEQ ID NO: 9353 - protein, 17 aa, Brucella spp.
GNSGPLPAPISKTINEK

SEQ ID NO: 9354 - protein, 14 aa, Brucella spp.
GNRNFEGRVSPDVQ

SEQ ID NO: 9355 - protein, 21 aa, Brucella spp.
GTVTKDLTKEPLGEDKDGNPV

SEQ ID NO: 9356 - protein, 7 aa, Brucella spp.
PAGQTYA

SEQ ID NO: 9357 - protein, 9 aa, Brucella spp.
DDNSTYVQN

SEQ ID NO: 9358 - protein, 19 aa, Brucella spp.
TTDHISPAGSIKAQSPAGK

SEQ ID NO: 9359 - protein, 9 aa, Brucella spp.
QYGTRRGNH

SEQ ID NO: 9360 - protein, 8 aa, Brucella spp.
ENGREGGY

SEQ ID NO: 9361 - protein, 4 aa, Brucella spp.
KEMS

SEQ ID NO: 9362 - protein, 16 aa, Brucella spp.
YGNGSSRDWAAKGTNL

SEQ ID NO: 9363 - protein, 6 aa, Brucella spp.
VRPRQR

SEQ ID NO: 9364 - protein, 6 aa, Brucella spp.
YADGTV

SEQ ID NO: 9365 - protein, 11 aa, Brucella spp.
SARAQDGNKAT

SEQ ID NO: 9366 - protein, 12 aa, Brucella spp.
GCKSCPPADKNF

SEQ ID NO: 9367 - protein, 8 aa, Brucella spp.
AKYADDPN

SEQ ID NO: 9368 - protein, 15 aa, Brucella spp.
LATQDNTDRQNSYRN

SEQ ID NO: 9369 - protein, 11 aa, Brucella spp.
VEANGRNGAAI

SEQ ID NO: 9370 - protein, 8 aa, Brucella spp.
AGKKPRDP

SEQ ID NO: 9371 - protein, 14 aa, Brucella spp.
IPITEGENAGKAIT

SEQ ID NO: 9372 - protein, 10 aa, Brucella spp.
ASELKRKDVT

SEQ ID NO: 9373 - protein, 11 aa, Brucella spp.
ETRSDNSLGPM

SEQ ID NO: 9374 - protein, 15 aa, Brucella spp.
RPVGGARADAGIDQG

SEQ ID NO: 9375 - protein, 6 aa, Brucella spp.
QSNPAF

SEQ ID NO: 9376 - protein, 6 aa, Brucella spp.
TKRNLS

SEQ ID NO: 9377 - protein, 5 aa, Brucella spp.
YDTQE

SEQ ID NO: 9378 - protein, 9 aa, Brucella spp.
GDAADTQGR

SEQ ID NO: 9379 - protein, 7 aa, Brucella spp.
REVTPAE

SEQ ID NO: 9380 - protein, 9 aa, Brucella spp.
QGKMAASAT

SEQ ID NO: 9381 - protein, 9 aa, Brucella spp.
MPDGSDQSL

SEQ ID NO: 9382 - protein, 7 aa, Brucella spp.
VSPQQSL

SEQ ID NO: 9383 - protein, 14 aa, Brucella spp.
ADMTREKDGAYGAA

SEQ ID NO: 9384 - protein, 5 aa, Brucella spp.
NEPDL

SEQ ID NO: 9385 - protein, 6 aa, Brucella spp.
LAQPGS

SEQ ID NO: 9386 - protein, 8 aa, Brucella spp.
PDGAPDAA

SEQ ID NO: 9387 - protein, 9 aa, Brucella spp.
QAATGFPDA

SEQ ID NO: 9388 - protein, 11 aa, Brucella spp.
TRANAAPALSA

SEQ ID NO: 9389 - protein, 5 aa, Brucella spp.
LGAPA

SEQ ID NO: 9390 - protein, 4 aa, Brucella spp.
RDIP

SEQ ID NO: 9391 - protein, 10 aa, Brucella spp.
EQGGEQRGRP

SEQ ID NO: 9392 - protein, 6 aa, Brucella spp.
APRVRS

SEQ ID NO: 9393 - protein, 6 aa, Brucella spp.
RPGALT

SEQ ID NO: 9394 - protein, 7 aa, Brucella spp.
ENIPAQA

SEQ ID NO: 9395 - protein, 5 aa, Brucella spp.
KDMGD

SEQ ID NO: 9396 - protein, 9 aa, Brucella spp.
DGKLTSGPM

SEQ ID NO: 9397 - protein, 4 aa, Brucella spp.
IPPE

SEQ ID NO: 9398 - protein, 9 aa, Brucella spp.
VPENATLSE

SEQ ID NO: 9399 - protein, 5 aa, Brucella spp.
YSGEP

SEQ ID NO: 9400 - protein, 8 aa, Brucella spp.
SGREGKEL

SEQ ID NO: 9401 - protein, 7 aa, Brucella spp.
TFAGAPA

SEQ ID NO: 9402 - protein, 11 aa, Brucella spp.
IPDGEKNLAPD

SEQ ID NO: 9403 - protein, 7 aa, Brucella spp.
AAGNRAR

SEQ ID NO: 9404 - protein, 5 aa, Brucella spp.
GATRA

SEQ ID NO: 9405 - protein, 12 aa, Brucella spp.
SASAQEEPTGLE

SEQ ID NO: 9406 - protein, 8 aa, Brucella spp.
DALPTEQL

SEQ ID NO: 9407 - protein, 6 aa, Brucella spp.
AAFPQQ

SEQ ID NO: 9408 - protein, 9 aa, Brucella spp.
ALNDKGYEV

SEQ ID NO: 9409 - protein, 13 aa, Brucella spp.
NAGVSGDTTTGGL

SEQ ID NO: 9410 - protein, 4 aa, Brucella spp.
IPDG

SEQ ID NO: 9411 - protein, 14 aa, Brucella spp.
DALRGIQPDITEKN

SEQ ID NO: 9412 - protein, 11 aa, Brucella spp.
PPNMGKDYAGK

SEQ ID NO: 9413 - protein, 9 aa, Brucella spp.
MHPNEKGVE

SEQ ID NO: 9414 - protein, 4 aa, Brucella spp.
GLPG

SEQ ID NO: 9415 - protein, 11 aa, Brucella spp.
DAFGSKKPHSI

SEQ ID NO: 9416 - protein, 9 aa, Brucella spp.
VSPSPGLNT

SEQ ID NO: 9417 - protein, 8 aa, Brucella spp.
PADPRKFT

SEQ ID NO: 9418 - protein, 9 aa, Brucella spp.
RDSVGGGPY

SEQ ID NO: 9419 - protein, 17 aa, Brucella spp.
SGQNWSASAVEAVRTIR

SEQ ID NO: 9420 - protein, 9 aa, Brucella spp.
PGGTGAAGA

SEQ ID NO: 9421 - protein, 8 aa, Brucella spp.
ANEREPVK

SEQ ID NO: 9422 - protein, 9 aa, Brucella spp.
ALAQTPSQI

SEQ ID NO: 9423 - protein, 8 aa, Brucella spp.
SYQSGNGK

SEQ ID NO: 9424 - protein, 11 aa, Brucella spp.
PTQKAPANVDH

SEQ ID NO: 9425 - protein, 8 aa, Brucella spp.
QKPGQNVS

SEQ ID NO: 9426 - protein, 4 aa, Brucella spp.
LNPN

SEQ ID NO: 9427 - protein, 4 aa, Brucella spp.
SGWM

SEQ ID NO: 9428 - protein, 6 aa, Brucella spp.
AAEEPQ

SEQ ID NO: 9429 - protein, 4 aa, Brucella spp.
GGAD

SEQ ID NO: 9430 - protein, 15 aa, Brucella spp.
VQAQSKRGTKTSYTY

SEQ ID NO: 9431 - protein, 6 aa, Brucella spp.
TRDQLA

SEQ ID NO: 9432 - protein, 10 aa, Brucella spp.
RASLEAKPSL

SEQ ID NO: 9433 - protein, 6 aa, Brucella spp.
GVPERQ

SEQ ID NO: 9434 - protein, 8 aa, Brucella spp.
QISQDGTR

SEQ ID NO: 9435 - protein, 9 aa, Brucella spp.
PRGAGRPVE

SEQ ID NO: 9436 - protein, 6 aa, Brucella spp.
PEEGRG

SEQ ID NO: 9437 - protein, 14 aa, Brucella spp.
LGDFPDKDTPDGAM

SEQ ID NO: 9438 - protein, 7 aa, Brucella spp.
VPAEGRK

SEQ ID NO: 9439 - protein, 8 aa, Brucella spp.
SDGDGLSL

SEQ ID NO: 9440 - protein, 7 aa, Brucella spp.
EYPGLSN

SEQ ID NO: 9441 - protein, 6 aa, Brucella spp.
NDSLDD

SEQ ID NO: 9442 - protein, 6 aa, Brucella spp.
WPGTNY

SEQ ID NO: 9443 - protein, 13 aa, Brucella spp.
AGYASPIRTPRGR

SEQ ID NO: 9444 - protein, 12 aa, Brucella spp.
LKSESERLRKSE

SEQ ID NO: 9445 - protein, 4 aa, Brucella spp.
GGLD

SEQ ID NO: 9446 - protein, 15 aa, Brucella spp.
LGQGEELEPARKKAE

SEQ ID NO: 9447 - protein, 8 aa, Brucella spp.
KKTGADAI

SEQ ID NO: 9448 - protein, 12 aa, Brucella spp.
AHGATGKGNDQV

SEQ ID NO: 9449 - protein, 11 aa, Brucella spp.
AKDKKGEAPFS

SEQ ID NO: 9450 - protein, 18 aa, Brucella spp.
HSSSEGKVLEDPSQEAPE

SEQ ID NO: 9451 - protein, 9 aa, Brucella spp.
SPETAPDKA

SEQ ID NO: 9452 - protein, 15 aa, Brucella spp.
KGDAVSINGERLSPA

SEQ ID NO: 9453 - protein, 10 aa, Brucella spp.
NDYGRDNGIG

SEQ ID NO: 9454 - protein, 8 aa, Brucella spp.
GVYETPGG

SEQ ID NO: 9455 - protein, 7 aa, Brucella spp.
SQRHVEG

SEQ ID NO: 9456 - protein, 7 aa, Brucella spp.
SAKSLYS

SEQ ID NO: 9457 - protein, 13 aa, Brucella spp.
DDQGAYDQKDAAG

SEQ ID NO: 9458 - protein, 9 aa, Brucella spp.
NQPQDAHEI

SEQ ID NO: 9459 - protein, 5 aa, Brucella spp.
GLPLP

SEQ ID NO: 9460 - protein, 6 aa, Brucella spp.
SGLNQT

SEQ ID NO: 9461 - protein, 19 aa, Brucella spp.
SAEPEQGTPPEELNATNDD

SEQ ID NO: 9462 - protein, 9 aa, Brucella spp.
AGFDEAKKY

SEQ ID NO: 9463 - protein, 8 aa, Brucella spp.
SCKEQTAA

SEQ ID NO: 9464 - protein, 11 aa, Brucella spp.
ASTQGTSGGLG

SEQ ID NO: 9465 - protein, 8 aa, Brucella spp.
GDMSPDAA

SEQ ID NO: 9466 - protein, 13 aa, Brucella spp.
SQQRTAEARGGEV

SEQ ID NO: 9467 - protein, 7 aa, Brucella spp.
KASGITD

SEQ ID NO: 9468 - protein, 23 aa, Brucella spp.
YTTPRGQKPGSPNKLNVTSTGAA

SEQ ID NO: 9469 - protein, 5 aa, Brucella spp.
GQPGI

SEQ ID NO: 9470 - protein, 6 aa, Brucella spp.
ARSQTK

SEQ ID NO: 9471 - protein, 5 aa, Brucella spp.
KPEYV

SEQ ID NO: 9472 - protein, 7 aa, Brucella spp.
VTGPDFK

SEQ ID NO: 9473 - protein, 6 aa, Brucella spp.
AERAEA

SEQ ID NO: 9474 - protein, 4 aa, Brucella spp.
IPGI

SEQ ID NO: 9475 - protein, 45 aa, Brucella spp.
AEKKGGRTSDDAPPPPRPQARPAAASQHRHPPQPRPAAKPGVPGV

SEQ ID NO: 9476 - protein, 13 aa, Brucella spp.
SGKGGVGKSTTAV

SEQ ID NO: 9477 - protein, 8 aa, Brucella spp.
SGRPETVE

SEQ ID NO: 9478 - protein, 8 aa, Brucella spp.
PPGTGDAQ

SEQ ID NO: 9479 - protein, 4 aa, Brucella spp.
STPQ

SEQ ID NO: 9480 - protein, 6 aa, Brucella spp.
PDTGTR

SEQ ID NO: 9481 - protein, 8 aa, Brucella spp.
GGARREAE

SEQ ID NO: 9482 - protein, 18 aa, Brucella spp.
YSDNGTPITVKEPDSEHA

SEQ ID NO: 9483 - protein, 17 aa, Brucella spp.
MKSGKGAGKPAPEIVFD

SEQ ID NO: 9484 - protein, 11 aa, Brucella spp.
LDQKEAKAGTF

SEQ ID NO: 9485 - protein, 9 aa, Brucella spp.
EGKATTKVT

SEQ ID NO: 9486 - protein, 8 aa, Brucella spp.
PQAKAGWK

SEQ ID NO: 9487 - protein, 10 aa, Brucella spp.
IETTKGDYAH

SEQ ID NO: 9488 - protein, 7 aa, Brucella spp.
KEVTSGV

SEQ ID NO: 9489 - protein, 9 aa, Brucella spp.
WSDGNLPSD

SEQ ID NO: 9490 - protein, 7 aa, Brucella spp.
PFDKDTT

SEQ ID NO: 9491 - protein, 16 aa, Brucella spp.
AKDGQNPHDLKHPAPQ

SEQ ID NO: 9492 - protein, 11 aa, Brucella spp.
ASTDEHAGHDA

SEQ ID NO: 9493 - protein, 4 aa, Brucella spp.
MPTK

SEQ ID NO: 9494 - protein, 9 aa, Brucella spp.
NDGKKADKL

SEQ ID NO: 9495 - protein, 7 aa, Brucella spp.
VSAPGVK

SEQ ID NO: 9496 - protein, 9 aa, Brucella spp.
GLDLPAGKT

SEQ ID NO: 9497 - protein, 5 aa, Brucella spp.
MQLKS

SEQ ID NO: 9498 - protein, 9 aa, Brucella spp.
HPYEEGETV

SEQ ID NO: 9499 - protein, 15 aa, Brucella spp.
AKKGQTKDHSEHSSH

SEQ ID NO: 9500 - protein, 10 aa, Brucella spp.
DAGSGLTTGF

SEQ ID NO: 9501 - protein, 7 aa, Brucella spp.
SRSTGPE

SEQ ID NO: 9502 - protein, 9 aa, Brucella spp.
LGPSEATRA

SEQ ID NO: 9503 - protein, 7 aa, Brucella spp.
AAPGLST

SEQ ID NO: 9504 - protein, 5 aa, Brucella spp.
GCSQT

SEQ ID NO: 9505 - protein, 11 aa, Brucella spp.
MSTGGISPMRP

SEQ ID NO: 9506 - protein, 5 aa, Brucella spp.
AITTP

SEQ ID NO: 9507 - protein, 6 aa, Brucella spp.
TEGPYA

SEQ ID NO: 9508 - protein, 10 aa, Brucella spp.
PDPTGQAPGT

SEQ ID NO: 9509 - protein, 5 aa, Brucella spp.
ANVEY

SEQ ID NO: 9510 - protein, 9 aa, Brucella spp.
PRWTPPPEM

SEQ ID NO: 9511 - protein, 20 aa, Brucella spp.
KPELEKYRNGQEPGPTNPLG

SEQ ID NO: 9512 - protein, 7 aa, Brucella spp.
GRDTGYR

SEQ ID NO: 9513 - protein, 31 aa, Brucella spp.
QMPAQAQAQTDTQAQGAAQPADDQPQAEEEK

SEQ ID NO: 9514 - protein, 7 aa, Brucella spp.
LSAPNRR

SEQ ID NO: 9515 - protein, 8 aa, Brucella spp.
SSEATVGS

SEQ ID NO: 9516 - protein, 16 aa, Brucella spp.
PLPDKGLPSPESSSFS

SEQ ID NO: 9517 - protein, 5 aa, Brucella spp.
SLKGS

SEQ ID NO: 9518 - protein, 10 aa, Brucella spp.
SLADGSLNSN

SEQ ID NO: 9519 - protein, 8 aa, Brucella spp.
LDGPGGNF

SEQ ID NO: 9520 - protein, 8 aa, Brucella spp.
YANADQKL

SEQ ID NO: 9521 - protein, 7 aa, Brucella spp.
VSEPANG

SEQ ID NO: 9522 - protein, 7 aa, Brucella spp.
DGRPPVD

SEQ ID NO: 9523 - protein, 6 aa, Brucella spp.
GAGTLD

SEQ ID NO: 9524 - protein, 10 aa, Brucella spp.
DTNGSRTLTG

SEQ ID NO: 9525 - protein, 11 aa, Brucella spp.
DRQGKGPDGGR

SEQ ID NO: 9526 - protein, 7 aa, Brucella spp.
VKDGGGF

SEQ ID NO: 9527 - protein, 9 aa, Brucella spp.
KASAETDND

SEQ ID NO: 9528 - protein, 7 aa, Brucella spp.
IADESKG

SEQ ID NO: 9529 - protein, 5 aa, Brucella spp.
AETYI

SEQ ID NO: 9530 - protein, 8 aa, Brucella spp.
GDRPTNDW

SEQ ID NO: 9531 - protein, 6 aa, Brucella spp.
NATLSA

SEQ ID NO: 9532 - protein, 9 aa, Brucella spp.
ENLNDPASR

SEQ ID NO: 9533 - protein, 12 aa, Brucella spp.
GMDGISSPRADI

SEQ ID NO: 9534 - protein, 7 aa, Brucella spp.
RAGSPVE

SEQ ID NO: 9535 - protein, 7 aa, Brucella spp.
DIEGNGL

SEQ ID NO: 9536 - protein, 6 aa, Brucella spp.
RNVAGS

SEQ ID NO: 9537 - protein, 12 aa, Brucella spp.
GTAENVRTGTEA

SEQ ID NO: 9538 - protein, 12 aa, Brucella spp.
GALGRSSEGFSA

SEQ ID NO: 9539 - protein, 14 aa, Brucella spp.
EITANGSLASDKAD

SEQ ID NO: 9540 - protein, 19 aa, Brucella spp.
SDKASGPMTVKGSARGDDK

SEQ ID NO: 9541 - protein, 17 aa, Brucella spp.
DVPQGTLAGRKLSNGGL

SEQ ID NO: 9542 - protein, 8 aa, Brucella spp.
GNATTGVA

SEQ ID NO: 9543 - protein, 7 aa, Brucella spp.
GKLDGGA

SEQ ID NO: 9544 - protein, 15 aa, Brucella spp.
AHLSGNVTQSAKGLL

SEQ ID NO: 9545 - protein, 7 aa, Brucella spp.
DAPDIST

SEQ ID NO: 9546 - protein, 9 aa, Brucella spp.
ATGAANADI

SEQ ID NO: 9547 - protein, 20 aa, Brucella spp.
LDASDGRQNATVTANASGIR

SEQ ID NO: 9548 - protein, 6 aa, Brucella spp.
GNAAAR

SEQ ID NO: 9549 - protein, 16 aa, Brucella spp.
DASANASGSKTDFTAN

SEQ ID NO: 9550 - protein, 14 aa, Brucella spp.
ANAAGSLEPKDGGF

SEQ ID NO: 9551 - protein, 7 aa, Brucella spp.
DVKQGAL

SEQ ID NO: 9552 - protein, 6 aa, Brucella spp.
PATISM

SEQ ID NO: 9553 - protein, 8 aa, Brucella spp.
NTGDGQVR

SEQ ID NO: 9554 - protein, 19 aa, Brucella spp.
GGTVNGTARITGTKEAPDI

SEQ ID NO: 9555 - protein, 21 aa, Brucella spp.
KKQGLGALNAEAKGTSANERL

SEQ ID NO: 9556 - protein, 12 aa, Brucella spp.
VTGGAASGTGID

SEQ ID NO: 9557 - protein, 8 aa, Brucella spp.
GAVPLGKG

SEQ ID NO: 9558 - protein, 23 aa, Brucella spp.
GQDLAGNVTGTARITGPLTNPAA

SEQ ID NO: 9559 - protein, 14 aa, Brucella spp.
GSGLAAKPLRESGL

SEQ ID NO: 9560 - protein, 8 aa, Brucella spp.
AGKYAAKA

SEQ ID NO: 9561 - protein, 11 aa, Brucella spp.
LDGPGGLNVTA

SEQ ID NO: 9562 - protein, 8 aa, Brucella spp.
GKIPFSGQ

SEQ ID NO: 9563 - protein, 10 aa, Brucella spp.
RGAQASGTLS

SEQ ID NO: 9564 - protein, 9 aa, Brucella spp.
NVSGGFQKP

SEQ ID NO: 9565 - protein, 4 aa, Brucella spp.
FVDP

SEQ ID NO: 9566 - protein, 4 aa, Brucella spp.
EGET

SEQ ID NO: 9567 - protein, 18 aa, Brucella spp.
ANLSSGGSLSASGTISTN

SEQ ID NO: 9568 - protein, 5 aa, Brucella spp.
ARYAD

SEQ ID NO: 9569 - protein, 11 aa, Brucella spp.
ITVPENLGGGA

SEQ ID NO: 9570 - protein, 8 aa, Brucella spp.
KNTPKNVQ

SEQ ID NO: 9571 - protein, 19 aa, Brucella spp.
RVETRKNKVPTPVARPTVP

SEQ ID NO: 9572 - protein, 6 aa, Brucella spp.
LDTELG

SEQ ID NO: 9573 - protein, 7 aa, Brucella spp.
RSEGDGI

SEQ ID NO: 9574 - protein, 8 aa, Brucella spp.
SSPELPQD

SEQ ID NO: 9575 - protein, 12 aa, Brucella spp.
AAELAGGSNNSL

SEQ ID NO: 9576 - protein, 7 aa, Brucella spp.
RQGTGLD

SEQ ID NO: 9577 - protein, 12 aa, Brucella spp.
TNSKGETSVRAG

SEQ ID NO: 9578 - protein, 11 aa, Brucella spp.
AGARGTTKGTV

SEQ ID NO: 9579 - protein, 18 aa, Brucella spp.
AFGAEDDSSGGIFYEKDY

SEQ ID NO: 9580 - protein, 9 aa, Brucella spp.
DKKQDPDII

SEQ ID NO: 9581 - protein, 18 aa, Brucella spp.
DVTTTGDRKNADGKEADL

SEQ ID NO: 9582 - protein, 20 aa, Brucella spp.
EGASGLVSDADKPASGSAGL

SEQ ID NO: 9583 - protein, 7 aa, Brucella spp.
KARGDYR

SEQ ID NO: 9584 - protein, 8 aa, Brucella spp.
GEGRYGGT

SEQ ID NO: 9585 - protein, 18 aa, Brucella spp.
DGREANDIPPDTEIPNNA

SEQ ID NO: 9586 - protein, 5 aa, Brucella spp.
VDPGP

SEQ ID NO: 9587 - protein, 32 aa, Brucella spp.
NIAPPPGNRRDKVQTPEEAGFAPGQEAKSGTI

SEQ ID NO: 9588 - protein, 13 aa, Brucella spp.
QEGYAKARVTGED

SEQ ID NO: 9589 - protein, 7 aa, Brucella spp.
HADNRVS

SEQ ID NO: 9590 - protein, 10 aa, Brucella spp.
LDPGRKAYYG

SEQ ID NO: 9591 - protein, 19 aa, Brucella spp.
KPGQEYDPDDIENAKKRLG

SEQ ID NO: 9592 - protein, 9 aa, Brucella spp.
DKIEPDGSL

SEQ ID NO: 9593 - protein, 6 aa, Brucella spp.
ERKPRR

SEQ ID NO: 9594 - protein, 15 aa, Brucella spp.
SGIGGSQDNSFDPKN

SEQ ID NO: 9595 - protein, 10 aa, Brucella spp.
AKPGVYTPDT

SEQ ID NO: 9596 - protein, 11 aa, Brucella spp.
TETSINAKTGF

SEQ ID NO: 9597 - protein, 6 aa, Brucella spp.
ANASQG

SEQ ID NO: 9598 - protein, 7 aa, Brucella spp.
DFTTAGL

SEQ ID NO: 9599 - protein, 11 aa, Brucella spp.
SRNNKPDPSSG

SEQ ID NO: 9600 - protein, 7 aa, Brucella spp.
TAEGRTY

SEQ ID NO: 9601 - protein, 6 aa, Brucella spp.
ADLPPS

SEQ ID NO: 9602 - protein, 9 aa, Brucella spp.
GGGGSVRGY

SEQ ID NO: 9603 - protein, 9 aa, Brucella spp.
VSAGNGNII

SEQ ID NO: 9604 - protein, 9 aa, Brucella spp.
EANGEVRTR

SEQ ID NO: 9605 - protein, 10 aa, Brucella spp.
VGEKSFPDFS

SEQ ID NO: 9606 - protein, 19 aa, Brucella spp.
NRRSGDPNYGFYVGIGQAF

SEQ ID NO: 9607 - protein, 4 aa, Brucella spp.
AHGS

SEQ ID NO: 9608 - protein, 7 aa, Brucella spp.
PKSEGGW

SEQ ID NO: 9609 - protein, 19 aa, Brucella spp.
LGGNDHPAHEDHHDAGSTT

SEQ ID NO: 9610 - protein, 8 aa, Brucella spp.
AGGPTGRE

SEQ ID NO: 9611 - protein, 5 aa, Brucella spp.
NNRSG

SEQ ID NO: 9612 - protein, 8 aa, Brucella spp.
GAGPDRSS

SEQ ID NO: 9613 - protein, 7 aa, Brucella spp.
LTERNRT

SEQ ID NO: 9614 - protein, 10 aa, Brucella spp.
ALASGANEGF

SEQ ID NO: 9615 - protein, 12 aa, Brucella spp.
PPLSGKAFSPDV

SEQ ID NO: 9616 - protein, 6 aa, Brucella spp.
DAGGNP

SEQ ID NO: 9617 - protein, 4 aa, Brucella spp.
GASV

SEQ ID NO: 9618 - protein, 6 aa, Brucella spp.
NHTENP

SEQ ID NO: 9619 - protein, 16 aa, Brucella spp.
RDKLRDTNGDTWGSGR

SEQ ID NO: 9620 - protein, 6 aa, Brucella spp.
SSPPPF

SEQ ID NO: 9621 - protein, 5 aa, Brucella spp.
TPTVR

SEQ ID NO: 9622 - protein, 5 aa, Brucella spp.
GYVRR

SEQ ID NO: 9623 - protein, 5 aa, Brucella spp.
KNTAT

SEQ ID NO: 9624 - protein, 5 aa, Brucella spp.
NNDRD

SEQ ID NO: 9625 - protein, 18 aa, Brucella spp.
EVQRVEDARTRQLTAQEA

SEQ ID NO: 9626 - protein, 8 aa, Brucella spp.
PKGQVGLE

SEQ ID NO: 9627 - protein, 11 aa, Brucella spp.
ATNEKADYQPD

SEQ ID NO: 9628 - protein, 7 aa, Brucella spp.
DPYRPLE

SEQ ID NO: 9629 - protein, 5 aa, Brucella spp.
EGDFA

SEQ ID NO: 9630 - protein, 7 aa, Brucella spp.
ANYSGQG

SEQ ID NO: 9631 - protein, 14 aa, Brucella spp.
KAQAAAKGEDLDRA

SEQ ID NO: 9632 - protein, 7 aa, Brucella spp.
VQPSEKH

SEQ ID NO: 9633 - protein, 10 aa, Brucella spp.
ASLRKSSPID

SEQ ID NO: 9634 - protein, 9 aa, Brucella spp.
ESGDIGEDA

SEQ ID NO: 9635 - protein, 10 aa, Brucella spp.
NGIEPGPATI

SEQ ID NO: 9636 - protein, 9 aa, Brucella spp.
TRNGGAVVT

SEQ ID NO: 9637 - protein, 6 aa, Brucella spp.
AVADEA

SEQ ID NO: 9638 - protein, 4 aa, Brucella spp.
RAGG

SEQ ID NO: 9639 - protein, 13 aa, Brucella spp.
APGSARSARENSL

SEQ ID NO: 9640 - protein, 9 aa, Brucella spp.
SPAPEKPGF

SEQ ID NO: 9641 - protein, 17 aa, Brucella spp.
QGSGGGESAAPPAKEEV

SEQ ID NO: 9642 - protein, 8 aa, Brucella spp.
SADPARGE

SEQ ID NO: 9643 - protein, 12 aa, Brucella spp.
HTGDKGGANKVG

SEQ ID NO: 9644 - protein, 8 aa, Brucella spp.
RPAASVEG

SEQ ID NO: 9645 - protein, 6 aa, Brucella spp.
FGAAGN

SEQ ID NO: 9646 - protein, 4 aa, Brucella spp.
SPKG

SEQ ID NO: 9647 - protein, 12 aa, Brucella spp.
FAGDKKDNERAD

SEQ ID NO: 9648 - protein, 27 aa, Brucella spp.
DNPVPLPAADAAPADSDKKPAEAAPAN

SEQ ID NO: 9649 - protein, 9 aa, Brucella spp.
GSTRLPNKP

SEQ ID NO: 9650 - protein, 7 aa, Brucella spp.
AAAAKLG

SEQ ID NO: 9651 - protein, 4 aa, Brucella spp.
TDSE

SEQ ID NO: 9652 - protein, 11 aa, Brucella spp.
RGDHESGSDRI

SEQ ID NO: 9653 - protein, 7 aa, Brucella spp.
LDPSGEI

SEQ ID NO: 9654 - protein, 9 aa, Brucella spp.
DLPTIDPDT

SEQ ID NO: 9655 - protein, 8 aa, Brucella spp.
EDGPADIA

SEQ ID NO: 9656 - protein, 9 aa, Brucella spp.
EEEKTNPNV

SEQ ID NO: 9657 - protein, 7 aa, Brucella spp.
SPLAGNR

SEQ ID NO: 9658 - protein, 7 aa, Brucella spp.
TAPYGEG

SEQ ID NO: 9659 - protein, 11 aa, Brucella spp.
GPSPLEKREKL

SEQ ID NO: 9660 - protein, 8 aa, Brucella spp.
DTQADLDR

SEQ ID NO: 9661 - protein, 11 aa, Brucella spp.
QGEAGANSDTA

SEQ ID NO: 9662 - protein, 6 aa, Brucella spp.
VETGAA

SEQ ID NO: 9663 - protein, 9 aa, Brucella spp.
AGDTAGAAR

SEQ ID NO: 9664 - protein, 4 aa, Brucella spp.
DRSM

SEQ ID NO: 9665 - protein, 9 aa, Brucella spp.
NVEDSENNV

SEQ ID NO: 9666 - protein, 12 aa, Brucella spp.
KQWAARPENDER

SEQ ID NO: 9667 - protein, 6 aa, Brucella spp.
GFATNG

SEQ ID NO: 9668 - protein, 8 aa, Brucella spp.
EGHPEERS

SEQ ID NO: 9669 - protein, 13 aa, Brucella spp.
GSDIRGTQLLAAE

SEQ ID NO: 9670 - protein, 9 aa, Brucella spp.
SEKRPDDSA

SEQ ID NO: 9671 - protein, 7 aa, Brucella spp.
GQEDAPR

SEQ ID NO: 9672 - protein, 4 aa, Brucella spp.
DGTP

SEQ ID NO: 9673 - protein, 9 aa, Brucella spp.
TKTEMRAGG

SEQ ID NO: 9674 - protein, 6 aa, Brucella spp.
HFPRTD

SEQ ID NO: 9675 - protein, 4 aa, Brucella spp.
RESF

SEQ ID NO: 9676 - protein, 8 aa, Brucella spp.
DRSELEDG

SEQ ID NO: 9677 - protein, 5 aa, Brucella spp.
THENG

SEQ ID NO: 9678 - protein, 4 aa, Brucella spp.
RPGL

SEQ ID NO: 9679 - protein, 6 aa, Brucella spp.
INTGAL

SEQ ID NO: 9680 - protein, 10 aa, Brucella spp.
NEGDAGWPGP

SEQ ID NO: 9681 - protein, 20 aa, Brucella spp.
RETYDEKDAQKLIAEVRAAL

SEQ ID NO: 9682 - protein, 5 aa, Brucella spp.
YRPQN

SEQ ID NO: 9683 - protein, 8 aa, Brucella spp.
GVGKTTTA

SEQ ID NO: 9684 - protein, 18 aa, Brucella spp.
KTDTVDQPTIDLSTPGEH

SEQ ID NO: 9685 - protein, 6 aa, Brucella spp.
ASHTGI

SEQ ID NO: 9686 - protein, 7 aa, Brucella spp.
LEEPPPH

SEQ ID NO: 9687 - protein, 4 aa, Brucella spp.
ESGT

SEQ ID NO: 9688 - protein, 6 aa, Brucella spp.
EKIEVD

SEQ ID NO: 9689 - protein, 9 aa, Brucella spp.
AGEGSARDS

SEQ ID NO: 9690 - protein, 10 aa, Brucella spp.
HGAGSVTAEA

SEQ ID NO: 9691 - protein, 6 aa, Brucella spp.
VGADPS

SEQ ID NO: 9692 - protein, 14 aa, Brucella spp.
DVSLSEDERVRGRE

SEQ ID NO: 9693 - protein, 9 aa, Brucella spp.
VDTATRPVQ

SEQ ID NO: 9694 - protein, 5 aa, Brucella spp.
DLPTL

SEQ ID NO: 9695 - protein, 50 aa, Brucella spp.
GLDNGSVSAPRPQPSATPRPNGGSAPQAHGAADAVGSSALAPAAGGPATA

SEQ ID NO: 9696 - protein, 21 aa, Brucella spp.
PPIQVSAPKPSEAAPQPSVPI

SEQ ID NO: 9697 - protein, 7 aa, Brucella spp.
PASIAPG

SEQ ID NO: 9698 - protein, 11 aa, Brucella spp.
TDDAPKSLPSD

SEQ ID NO: 9699 - protein, 16 aa, Brucella spp.
VAGQTIAEAEAERRDN

SEQ ID NO: 9700 - protein, 8 aa, Brucella spp.
DARADPDV

SEQ ID NO: 9701 - protein, 11 aa, Brucella spp.
VPDKSKDEDID

SEQ ID NO: 9702 - protein, 5 aa, Brucella spp.
KELQA

SEQ ID NO: 9703 - protein, 10 aa, Brucella spp.
EASASSGGGL

SEQ ID NO: 9704 - protein, 7 aa, Brucella spp.
SGKGTLS

SEQ ID NO: 9705 - protein, 9 aa, Brucella spp.
NDAKAKLEA

SEQ ID NO: 9706 - protein, 9 aa, Brucella spp.
AEKTQSLTA

SEQ ID NO: 9707 - protein, 9 aa, Brucella spp.
GLGPRSARR

SEQ ID NO: 9708 - protein, 6 aa, Brucella spp.
MQEAAE

SEQ ID NO: 9709 - protein, 7 aa, Brucella spp.
VDTSDPC

SEQ ID NO: 9710 - protein, 7 aa, Brucella spp.
DERRDPA

SEQ ID NO: 9711 - protein, 10 aa, Brucella spp.
PLDGIGPDDL

SEQ ID NO: 9712 - protein, 8 aa, Brucella spp.
TVEGQTTA

SEQ ID NO: 9713 - protein, 8 aa, Brucella spp.
LARPGPRF

SEQ ID NO: 9714 - protein, 8 aa, Brucella spp.
GAESEDVA

SEQ ID NO: 9715 - protein, 9 aa, Brucella spp.
GNKNADVKP

SEQ ID NO: 9716 - protein, 8 aa, Brucella spp.
VASAGGRV

SEQ ID NO: 9717 - protein, 16 aa, Brucella spp.
FGAKGKDGTLKPGDEV

SEQ ID NO: 9718 - protein, 9 aa, Brucella spp.
REKARREES

SEQ ID NO: 9719 - protein, 7 aa, Brucella spp.
FANGERV

SEQ ID NO: 9720 - protein, 5 aa, Brucella spp.
KRRGN

SEQ ID NO: 9721 - protein, 10 aa, Brucella spp.
EESRAEQRSE

SEQ ID NO: 9722 - protein, 7 aa, Brucella spp.
ESDPWDG

SEQ ID NO: 9723 - protein, 5 aa, Brucella spp.
KYPIG

SEQ ID NO: 9724 - protein, 6 aa, Brucella spp.
ITGTVT

SEQ ID NO: 9725 - protein, 6 aa, Brucella spp.
KNVHPG

SEQ ID NO: 9726 - protein, 5 aa, Brucella spp.
STTQE

SEQ ID NO: 9727 - protein, 5 aa, Brucella spp.
LDNPW

SEQ ID NO: 9728 - protein, 8 aa, Brucella spp.
GEVKNKTE

SEQ ID NO: 9729 - protein, 5 aa, Brucella spp.
NRPGE

SEQ ID NO: 9730 - protein, 4 aa, Brucella spp.
NKGE

SEQ ID NO: 9731 - protein, 17 aa, Brucella spp.
LSGDKVGEAAASGELRK

SEQ ID NO: 9732 - protein, 5 aa, Brucella spp.
VTDGG

SEQ ID NO: 9733 - protein, 13 aa, Brucella spp.
DLSRDRDEQRPER

SEQ ID NO: 9734 - protein, 6 aa, Brucella spp.
KTRKLQ

SEQ ID NO: 9735 - protein, 20 aa, Brucella spp.
AEEKEAVAQYGSSDSGASLG

SEQ ID NO: 9736 - protein, 11 aa, Brucella spp.
GPAASGKGTLA

SEQ ID NO: 9737 - protein, 12 aa, Brucella spp.
LPLDDEALATDA

SEQ ID NO: 9738 - protein, 5 aa, Brucella spp.
GEAAS

SEQ ID NO: 9739 - protein, 4 aa, Brucella spp.
SSVL

SEQ ID NO: 9740 - protein, 4 aa, Brucella spp.
DGRD

SEQ ID NO: 9741 - protein, 7 aa, Brucella spp.
SPEVRAR

SEQ ID NO: 9742 - protein, 6 aa, Brucella spp.
RGDTAD

SEQ ID NO: 9743 - protein, 20 aa, Brucella spp.
KKRDERDMNRTDSPLRPAED

SEQ ID NO: 9744 - protein, 7 aa, Brucella spp.
ARHSQAL

SEQ ID NO: 9745 - protein, 9 aa, Brucella spp.
RIPGDKSIS

SEQ ID NO: 9746 - protein, 6 aa, Brucella spp.
SGKTRI

SEQ ID NO: 9747 - protein, 4 aa, Brucella spp.
NTGR

SEQ ID NO: 9748 - protein, 4 aa, Brucella spp.
IRKE

SEQ ID NO: 9749 - protein, 8 aa, Brucella spp.
GNAGTGAR

SEQ ID NO: 9750 - protein, 7 aa, Brucella spp.
SLSKRPM

SEQ ID NO: 9751 - protein, 6 aa, Brucella spp.
AAEGDR

SEQ ID NO: 9752 - protein, 6 aa, Brucella spp.
PRTANP

SEQ ID NO: 9753 - protein, 5 aa, Brucella spp.
NTPGV

SEQ ID NO: 9754 - protein, 9 aa, Brucella spp.
TVETDKDGV

SEQ ID NO: 9755 - protein, 19 aa, Brucella spp.
GKLTGQTIDVPGDPSSTAF

SEQ ID NO: 9756 - protein, 7 aa, Brucella spp.
LAGGEDV

SEQ ID NO: 9757 - protein, 7 aa, Brucella spp.
PPERAPS

SEQ ID NO: 9758 - protein, 6 aa, Brucella spp.
FAEGET

SEQ ID NO: 9759 - protein, 7 aa, Brucella spp.
VKESDRL

SEQ ID NO: 9760 - protein, 5 aa, Brucella spp.
GLEAN

SEQ ID NO: 9761 - protein, 8 aa, Brucella spp.
GVDCTEGE

SEQ ID NO: 9762 - protein, 15 aa, Brucella spp.
RGRPGGKGLGGGTVG

SEQ ID NO: 9763 - protein, 8 aa, Brucella spp.
EKPVTVDD

SEQ ID NO: 9764 - protein, 8 aa, Brucella spp.
HPSTPPNM

SEQ ID NO: 9765 - protein, 5 aa, Brucella spp.
QPTRM

SEQ ID NO: 9766 - protein, 12 aa, Brucella spp.
ANSTDGNGTLEG

SEQ ID NO: 9767 - protein, 7 aa, Brucella spp.
STQNIST

SEQ ID NO: 9768 - protein, 9 aa, Brucella spp.
PEQWGETTA

SEQ ID NO: 9769 - protein, 15 aa, Brucella spp.
REEPQPAVLSHTGSA

SEQ ID NO: 9770 - protein, 7 aa, Brucella spp.
STSFEAN

SEQ ID NO: 9771 - protein, 14 aa, Brucella spp.
IDGGGEKARDRHVS

SEQ ID NO: 9772 - protein, 5 aa, Brucella spp.
DPGSP

SEQ ID NO: 9773 - protein, 9 aa, Brucella spp.
YGGPAPAAG

SEQ ID NO: 9774 - protein, 8 aa, Brucella spp.
TVKGGTYY

SEQ ID NO: 9775 - protein, 7 aa, Brucella spp.
QEIAGEN

SEQ ID NO: 9776 - protein, 12 aa, Brucella spp.
GGANLPNQDEVF

SEQ ID NO: 9777 - protein, 5 aa, Brucella spp.
SAAGI

SEQ ID NO: 9778 - protein, 5 aa, Brucella spp.
TAGGA

SEQ ID NO: 9779 - protein, 7 aa, Brucella spp.
AATGEVV

SEQ ID NO: 9780 - protein, 9 aa, Brucella spp.
AEDLGGGDV

SEQ ID NO: 9781 - protein, 5 aa, Brucella spp.
ANDDA

SEQ ID NO: 9782 - protein, 22 aa, Brucella spp.
NLASEKRSFIPRGDGAAPLYDP

SEQ ID NO: 9783 - protein, 4 aa, Brucella spp.
TRIP

SEQ ID NO: 9784 - protein, 4 aa, Brucella spp.
SDFD

SEQ ID NO: 9785 - protein, 9 aa, Brucella spp.
YEAEGIAKH

SEQ ID NO: 9786 - protein, 8 aa, Brucella spp.
YGAGNYGM

SEQ ID NO: 9787 - protein, 6 aa, Brucella spp.
AGRAYS

SEQ ID NO: 9788 - protein, 5 aa, Brucella spp.
GEQAA

SEQ ID NO: 9789 - protein, 21 aa, Brucella spp.
RDGIERTGGTWSAEEEAEFKR

SEQ ID NO: 9790 - protein, 8 aa, Brucella spp.
VDPRKSRE

SEQ ID NO: 9791 - protein, 15 aa, Brucella spp.
LNAPVEPTRFGIFRM

SEQ ID NO: 9792 - protein, 4 aa, Brucella spp.
IPRG

SEQ ID NO: 9793 - protein, 4 aa, Brucella spp.
DADA

SEQ ID NO: 9794 - protein, 11 aa, Brucella spp.
RVGPAASAQSY

SEQ ID NO: 9795 - protein, 9 aa, Brucella spp.
AKETGAEAI

SEQ ID NO: 9796 - protein, 9 aa, Brucella spp.
YHGDNQDGA

SEQ ID NO: 9797 - protein, 5 aa, Brucella spp.
EADRI

SEQ ID NO: 9798 - protein, 12 aa, Brucella spp.
RAGGGGKGMRRV

SEQ ID NO: 9799 - protein, 14 aa, Brucella spp.
ESARREAEASFGDG

SEQ ID NO: 9800 - protein, 4 aa, Brucella spp.
DNHG

SEQ ID NO: 9801 - protein, 9 aa, Brucella spp.
EAPAPGMTE

SEQ ID NO: 9802 - protein, 6 aa, Brucella spp.
YSGAGT

SEQ ID NO: 9803 - protein, 5 aa, Brucella spp.
EGLRP

SEQ ID NO: 9804 - protein, 12 aa, Brucella spp.
SGEALPKRQDEL

SEQ ID NO: 9805 - protein, 6 aa, Brucella spp.
AEDPAR

SEQ ID NO: 9806 - protein, 15 aa, Brucella spp.
ENARVDSGVRTGDTI

SEQ ID NO: 9807 - protein, 8 aa, Brucella spp.
GATRDEAL

SEQ ID NO: 9808 - protein, 5 aa, Brucella spp.
TGDVD

SEQ ID NO: 9809 - protein, 7 aa, Brucella spp.
DAQPSDI

SEQ ID NO: 9810 - protein, 10 aa, Brucella spp.
APEKSDPWSG

SEQ ID NO: 9811 - protein, 5 aa, Brucella spp.
GERRT

SEQ ID NO: 9812 - protein, 5 aa, Brucella spp.
TARGD

SEQ ID NO: 9813 - protein, 9 aa, Brucella spp.
RVSEASVSR

SEQ ID NO: 9814 - protein, 12 aa, Brucella spp.
GAEEDASSESRI

SEQ ID NO: 9815 - protein, 9 aa, Brucella spp.
ASVAKGDPL

SEQ ID NO: 9816 - protein, 9 aa, Brucella spp.
TAPRDGKVA

SEQ ID NO: 9817 - protein, 7 aa, Brucella spp.
AGDQVNE

SEQ ID NO: 9818 - protein, 10 aa, Brucella spp.
DQVKKGAETA

SEQ ID NO: 9819 - protein, 7 aa, Brucella spp.
AGGIKGE

SEQ ID NO: 9820 - protein, 16 aa, Brucella spp.
DDAGEPKQGVSAANQI

SEQ ID NO: 9821 - protein, 12 aa, Brucella spp.
PTATGPDLTARG

SEQ ID NO: 9822 - protein, 8 aa, Brucella spp.
GRDGQQAE

SEQ ID NO: 9823 - protein, 8 aa, Brucella spp.
KGAYGKGL

SEQ ID NO: 9824 - protein, 6 aa, Brucella spp.
NKGGIT

SEQ ID NO: 9825 - protein, 9 aa, Brucella spp.
SVTPGDKDF

SEQ ID NO: 9826 - protein, 5 aa, Brucella spp.
KSAGA

SEQ ID NO: 9827 - protein, 6 aa, Brucella spp.
EGLSNT

SEQ ID NO: 9828 - protein, 8 aa, Brucella spp.
GTNAQGTL

SEQ ID NO: 9829 - protein, 15 aa, Brucella spp.
AKDATKNPAAKDAIQ

SEQ ID NO: 9830 - protein, 7 aa, Brucella spp.
AKNIPAE

SEQ ID NO: 9831 - protein, 13 aa, Brucella spp.
IERAGSTDDSAAV

SEQ ID NO: 9832 - protein, 9 aa, Brucella spp.
HDGKPIETA

SEQ ID NO: 9833 - protein, 12 aa, Brucella spp.
TYSETGDLSSPS

SEQ ID NO: 9834 - protein, 6 aa, Brucella spp.
FSPEEL

SEQ ID NO: 9835 - protein, 9 aa, Brucella spp.
GGPGQQKLK

SEQ ID NO: 9836 - protein, 4 aa, Brucella spp.
GLGA

SEQ ID NO: 9837 - protein, 4 aa, Brucella spp.
TVSL

SEQ ID NO: 9838 - protein, 10 aa, Brucella spp.
DSIGQPKVES

SEQ ID NO: 9839 - protein, 6 aa, Brucella spp.
GSDNFA

SEQ ID NO: 9840 - protein, 8 aa, Brucella spp.
AAKVGRPL

SEQ ID NO: 9841 - protein, 13 aa, Brucella spp.
ANGPDGAKNPSYR

SEQ ID NO: 9842 - protein, 12 aa, Brucella spp.
DAPPPGTVPSCA

SEQ ID NO: 9843 - protein, 9 aa, Brucella spp.
GENGSGKTN

SEQ ID NO: 9844 - protein, 7 aa, Brucella spp.
PGRGLRR

SEQ ID NO: 9845 - protein, 10 aa, Brucella spp.
DVARANAEGG

SEQ ID NO: 9846 - protein, 16 aa, Brucella spp.
EIGTGTAGGGEGGRKV

SEQ ID NO: 9847 - protein, 4 aa, Brucella spp.
SADD

SEQ ID NO: 9848 - protein, 9 aa, Brucella spp.
TGGASDRRR

SEQ ID NO: 9849 - protein, 4 aa, Brucella spp.
MRSR

SEQ ID NO: 9850 - protein, 9 aa, Brucella spp.
LNDGSNDDQ

SEQ ID NO: 9851 - protein, 6 aa, Brucella spp.
AEGPFP

SEQ ID NO: 9852 - protein, 21 aa, Brucella spp.
LRDGRARDRAAGRTLDGPHRT

SEQ ID NO: 9853 - protein, 6 aa, Brucella spp.
RPKSMP

SEQ ID NO: 9854 - protein, 6 aa, Brucella spp.
STGEQK

SEQ ID NO: 9855 - protein, 4 aa, Brucella spp.
GASL

SEQ ID NO: 9856 - protein, 8 aa, Brucella spp.
QAGATTVP

SEQ ID NO: 9857 - protein, 5 aa, Brucella spp.
LPDGA

SEQ ID NO: 9858 - protein, 9 aa, Brucella spp.
TNPDGGSMS

SEQ ID NO: 9859 - protein, 4 aa, Brucella spp.
GKSS

SEQ ID NO: 9860 - protein, 5 aa, Brucella spp.
DFPEL

SEQ ID NO: 9861 - protein, 6 aa, Brucella spp.
STEETR

SEQ ID NO: 9862 - protein, 4 aa, Brucella spp.
SDGA

SEQ ID NO: 9863 - protein, 5 aa, Brucella spp.
TDGHR

SEQ ID NO: 9864 - protein, 10 aa, Brucella spp.
LEAPSGTEGM

SEQ ID NO: 9865 - protein, 12 aa, Brucella spp.
IPSGNDKKLTID

SEQ ID NO: 9866 - protein, 10 aa, Brucella spp.
STISSERGRA

SEQ ID NO: 9867 - protein, 21 aa, Brucella spp.
NNPDSGSATDELAADYDGDPL

SEQ ID NO: 9868 - protein, 5 aa, Brucella spp.
QLSGT

SEQ ID NO: 9869 - protein, 24 aa, Brucella spp.
AGSPTLVRDTGDEDVLYVLMPMRV

SEQ ID NO: 9870 - protein, 12 aa, Brucella spp.
LDEAALPESAAA

SEQ ID NO: 9871 - protein, 9 aa, Brucella spp.
KANGFDGEA

SEQ ID NO: 9872 - protein, 6 aa, Brucella spp.
GRDGAI

SEQ ID NO: 9873 - protein, 12 aa, Brucella spp.
TGEAPENGQPQL

SEQ ID NO: 9874 - protein, 5 aa, Brucella spp.
RNLPE

SEQ ID NO: 9875 - protein, 9 aa, Brucella spp.
EGKPGDAGL

SEQ ID NO: 9876 - protein, 8 aa, Brucella spp.
RKANGKTV

SEQ ID NO: 9877 - protein, 12 aa, Brucella spp.
PEGADASETRRL

SEQ ID NO: 9878 - protein, 17 aa, Brucella spp.
TPANDMGPAALEQAARD

SEQ ID NO: 9879 - protein, 16 aa, Brucella spp.
LAAQHGARVATTEGEA

SEQ ID NO: 9880 - protein, 5 aa, Brucella spp.
AGAVA

SEQ ID NO: 9881 - protein, 9 aa, Brucella spp.
GRDSDPKIT

SEQ ID NO: 9882 - protein, 5 aa, Brucella spp.
DIKSA

SEQ ID NO: 9883 - protein, 5 aa, Brucella spp.
MGGAA

SEQ ID NO: 9884 - protein, 6 aa, Brucella spp.
NAFRPG

SEQ ID NO: 9885 - protein, 4 aa, Brucella spp.
SRKG

SEQ ID NO: 9886 - protein, 8 aa, Brucella spp.
GNTDAEGR

SEQ ID NO: 9887 - protein, 7 aa, Brucella spp.
ADEEEPE

SEQ ID NO: 9888 - protein, 7 aa, Brucella spp.
ARETADP

SEQ ID NO: 9889 - protein, 6 aa, Brucella spp.
KLSSRV

SEQ ID NO: 9890 - protein, 10 aa, Brucella spp.
NVTTDGFAGS

SEQ ID NO: 9891 - protein, 13 aa, Brucella spp.
EKPASPVGGEAQA

SEQ ID NO: 9892 - protein, 8 aa, Brucella spp.
IPASPAAF

SEQ ID NO: 9893 - protein, 4 aa, Brucella spp.
KGPP

SEQ ID NO: 9894 - protein, 15 aa, Brucella spp.
DSRGQGRSTRTDEPI

SEQ ID NO: 9895 - protein, 11 aa, Brucella spp.
ANVSPAGNAGY

SEQ ID NO: 9896 - protein, 8 aa, Brucella spp.
AAGKPLPE

SEQ ID NO: 9897 - protein, 8 aa, Brucella spp.
EPNYTDED

SEQ ID NO: 9898 - protein, 10 aa, Brucella spp.
MFGPGNAQLP

SEQ ID NO: 9899 - protein, 9 aa, Brucella spp.
ISETGGAFD

SEQ ID NO: 9900 - protein, 6 aa, Brucella spp.
EPGRGM

SEQ ID NO: 9901 - protein, 25 aa, Brucella spp.
IGSNTEEVTASVREAKSGISRAEEY

SEQ ID NO: 9902 - protein, 14 aa, Brucella spp.
DAGLTEEEVSNERT

SEQ ID NO: 9903 - protein, 9 aa, Brucella spp.
SGGPSTRTI

SEQ ID NO: 9904 - protein, 13 aa, Brucella spp.
DITREKGPKRVGP

SEQ ID NO: 9905 - protein, 9 aa, Brucella spp.
AMSSTASAT

SEQ ID NO: 9906 - protein, 5 aa, Brucella spp.
ACATS

SEQ ID NO: 9907 - protein, 20 aa, Brucella spp.
SSKYNDTPSTASRAYDKNRD

SEQ ID NO: 9908 - protein, 7 aa, Brucella spp.
GATSDGY

SEQ ID NO: 9909 - protein, 7 aa, Brucella spp.
APSGEGA

SEQ ID NO: 9910 - protein, 13 aa, Brucella spp.
HATSTPAGDAPEI

SEQ ID NO: 9911 - protein, 15 aa, Brucella spp.
TKSLTGHSLGATGVQ

SEQ ID NO: 9912 - protein, 16 aa, Brucella spp.
GFGGTNATLVFQRYQG

SEQ ID NO: 9913 - protein, 12 aa, Brucella spp.
ATKEGDTGSPEV

SEQ ID NO: 9914 - protein, 10 aa, Brucella spp.
GHKNDNHSRR

SEQ ID NO: 9915 - protein, 10 aa, Brucella spp.
PKGMGSTEAV

SEQ ID NO: 9916 - protein, 10 aa, Brucella spp.
KAGHAGTLDP

SEQ ID NO: 9917 - protein, 9 aa, Brucella spp.
EATKTVPYA

SEQ ID NO: 9918 - protein, 26 aa, Brucella spp.
GEERSTDDLEGQPTKTSDKRPSREEV

SEQ ID NO: 9919 - protein, 4 aa, Brucella spp.
VPPQ

SEQ ID NO: 9920 - protein, 5 aa, Brucella spp.
DGERA

SEQ ID NO: 9921 - protein, 9 aa, Brucella spp.
AREGETVEI

SEQ ID NO: 9922 - protein, 6 aa, Brucella spp.
DADRTE

SEQ ID NO: 9923 - protein, 4 aa, Brucella spp.
KGTY

SEQ ID NO: 9924 - protein, 20 aa, Brucella spp.
PLPPKDEDGNVIEPAPRRDF

SEQ ID NO: 9925 - protein, 10 aa, Brucella spp.
LSDDQAQRVR

SEQ ID NO: 9926 - protein, 7 aa, Brucella spp.
DAPLEAD

SEQ ID NO: 9927 - protein, 5 aa, Brucella spp.
CVTTR

SEQ ID NO: 9928 - protein, 25 aa, Brucella spp.
HVETRRDKAMARSHDTKGSGGLSQR

SEQ ID NO: 9929 - protein, 7 aa, Brucella spp.
GSADPQA

SEQ ID NO: 9930 - protein, 5 aa, Brucella spp.
PDTSF

SEQ ID NO: 9931 - protein, 20 aa, Brucella spp.
LSHDDDEDGGADEAPRNGDE

SEQ ID NO: 9932 - protein, 8 aa, Brucella spp.
SVNPKKTL

SEQ ID NO: 9933 - protein, 11 aa, Brucella spp.
KRPGVEQSTVR

SEQ ID NO: 9934 - protein, 6 aa, Brucella spp.
FSHGRT

SEQ ID NO: 9935 - protein, 96 aa, Brucella spp.
KRKFSRPDEKPEVEAAAAPKPAAPAAAPQQAPASAPVSASAAQASAPQPAPVKAPATKAPAAPSAPVTKPHVAQQRPVHQRPGGQQAQRPRPADRS

SEQ ID NO: 9936 - protein, 10 aa, Brucella spp.
RSEMDARRRA

SEQ ID NO: 9937 - protein, 107 aa, Brucella spp.
EVEERARAVEEAKRRAEEDARRAKEHEESARRQAEEEARLKAEAEARRKAEEEAAKRMPQPEARSERRDDARPAPYGARPQQAGRPQGGRPQPAGRPQQGSPRPAPI

SEQ ID NO: 9938 - protein, 57 aa, Brucella spp.
APIAGKPLPQSQLRKPGQSDDDDDRRSGAARRGVAAKPEVRAPKVVKGEDDRRRGKL

SEQ ID NO: 9939 - protein, 12 aa, Brucella spp.
SNLEEEGRSRSL

SEQ ID NO: 9940 - protein, 20 aa, Brucella spp.
RRQEKFKRSQMQETREKISR

SEQ ID NO: 9941 - protein, 7 aa, Brucella spp.
AESDVEE

SEQ ID NO: 9942 - protein, 7 aa, Brucella spp.
DNESAMV

SEQ ID NO: 9943 - protein, 5 aa, Brucella spp.
HGKTS

SEQ ID NO: 9944 - protein, 8 aa, Brucella spp.
SGEAGGIT

SEQ ID NO: 9945 - protein, 7 aa, Brucella spp.
ARGAQAT

SEQ ID NO: 9946 - protein, 5 aa, Brucella spp.
SVMPQ

SEQ ID NO: 9947 - protein, 4 aa, Brucella spp.
KAAG

SEQ ID NO: 9948 - protein, 10 aa, Brucella spp.
DKPAADPQKV

SEQ ID NO: 9949 - protein, 5 aa, Brucella spp.
AKNKI

SEQ ID NO: 9950 - protein, 9 aa, Brucella spp.
ADPDRTAEG

SEQ ID NO: 9951 - protein, 7 aa, Brucella spp.
DRGRGSV

SEQ ID NO: 9952 - protein, 4 aa, Brucella spp.
TLHP

SEQ ID NO: 9953 - protein, 13 aa, Brucella spp.
DRGEHVKEAGPAM

SEQ ID NO: 9954 - protein, 8 aa, Brucella spp.
QGTPQAGD

SEQ ID NO: 9955 - protein, 8 aa, Brucella spp.
EAKAREIA

SEQ ID NO: 9956 - protein, 13 aa, Brucella spp.
KAVARQSGARGSL

SEQ ID NO: 9957 - protein, 6 aa, Brucella spp.
VSGTKE

SEQ ID NO: 9958 - protein, 5 aa, Brucella spp.
VQGSI

SEQ ID NO: 9959 - protein, 7 aa, Brucella spp.
KLGTDEV

SEQ ID NO: 9960 - protein, 9 aa, Brucella spp.
GAGGITESD

SEQ ID NO: 9961 - protein, 7 aa, Brucella spp.
SLAEASN

SEQ ID NO: 9962 - protein, 14 aa, Brucella spp.
ANKQARDSAEQQGI

SEQ ID NO: 9963 - protein, 6 aa, Brucella spp.
SPERRE

SEQ ID NO: 9964 - protein, 11 aa, Brucella spp.
RVTEGKVERGA

SEQ ID NO: 9965 - protein, 9 aa, Brucella spp.
VAEVPSGQE

SEQ ID NO: 9966 - protein, 6 aa, Brucella spp.
QQEMND

SEQ ID NO: 9967 - protein, 8 aa, Brucella spp.
RESGSADD

SEQ ID NO: 9968 - protein, 8 aa, Brucella spp.
GPDGSVVP

SEQ ID NO: 9969 - protein, 6 aa, Brucella spp.
QTLPGR

SEQ ID NO: 9970 - protein, 9 aa, Brucella spp.
EGVTPQADL

SEQ ID NO: 9971 - protein, 4 aa, Brucella spp.
SALG

SEQ ID NO: 9972 - protein, 18 aa, Brucella spp.
AGAVVTGSTKVDQAIRTG

SEQ ID NO: 9973 - protein, 9 aa, Brucella spp.
EAAADGVRK

SEQ ID NO: 9974 - protein, 5 aa, Brucella spp.
LDQAR

SEQ ID NO: 9975 - protein, 4 aa, Brucella spp.
GPEI

SEQ ID NO: 9976 - protein, 6 aa, Brucella spp.
GKAAAG

SEQ ID NO: 9977 - protein, 7 aa, Brucella spp.
AREKSID

SEQ ID NO: 9978 - protein, 17 aa, Brucella spp.
QKAARSRYGQESNIRAD

SEQ ID NO: 9979 - protein, 8 aa, Brucella spp.
INAKSGEI

SEQ ID NO: 9980 - protein, 8 aa, Brucella spp.
DRNPDAQV

SEQ ID NO: 9981 - protein, 6 aa, Brucella spp.
AAQSAK

SEQ ID NO: 9982 - protein, 16 aa, Brucella spp.
REAERDRQYDEYKDRV

SEQ ID NO: 9983 - protein, 6 aa, Brucella spp.
REQRGP

SEQ ID NO: 9984 - protein, 8 aa, Brucella spp.
ARDPGSRA

SEQ ID NO: 9985 - protein, 6 aa, Brucella spp.
DASIDP

SEQ ID NO: 9986 - protein, 4 aa, Brucella spp.
EDAE

SEQ ID NO: 9987 - protein, 6 aa, Brucella spp.
RRGQNV

SEQ ID NO: 9988 - protein, 15 aa, Brucella spp.
EDEESERRQKEFAER

SEQ ID NO: 9989 - protein, 6 aa, Brucella spp.
GEISSI

SEQ ID NO: 9990 - protein, 15 aa, Brucella spp.
DGFDEDTAGEIQDRA

SEQ ID NO: 9991 - protein, 11 aa, Brucella spp.
AEQDARRKELG

SEQ ID NO: 9992 - protein, 6 aa, Brucella spp.
EDGVKT

SEQ ID NO: 9993 - protein, 10 aa, Brucella spp.
ERKDGDTINH

SEQ ID NO: 9994 - protein, 19 aa, Brucella spp.
AAASEDVEAEEAGDEEAAS

SEQ ID NO: 9995 - protein, 9 aa, Brucella spp.
SVSEGHPDK

SEQ ID NO: 9996 - protein, 7 aa, Brucella spp.
ARRTGVD

SEQ ID NO: 9997 - protein, 11 aa, Brucella spp.
KNKDGSIAHDA

SEQ ID NO: 9998 - protein, 6 aa, Brucella spp.
FRSAAR

SEQ ID NO: 9999 - protein, 24 aa, Brucella spp.
SADIAQGVDNAADRQGEEGAGDQG

SEQ ID NO: 10000 - protein, 22 aa, Brucella spp.
EARHKGEGDARKLGPDAKSQVT

SEQ ID NO: 10001 - protein, 9 aa, Brucella spp.
YENGKAAEV

SEQ ID NO: 10002 - protein, 6 aa, Brucella spp.
SWDSRK

SEQ ID NO: 10003 - protein, 11 aa, Brucella spp.
GGPDGDAGLTG

SEQ ID NO: 10004 - protein, 10 aa, Brucella spp.
GGAAPHGGGA

SEQ ID NO: 10005 - protein, 13 aa, Brucella spp.
GKDTTKVDRSAAY

SEQ ID NO: 10006 - protein, 12 aa, Brucella spp.
GTGKVAESAVED

SEQ ID NO: 10007 - protein, 5 aa, Brucella spp.
SPTGI

SEQ ID NO: 10008 - protein, 9 aa, Brucella spp.
RKPGRDGSF

SEQ ID NO: 10009 - protein, 4 aa, Brucella spp.
LTQP

SEQ ID NO: 10010 - protein, 8 aa, Brucella spp.
ARTDAGPL

SEQ ID NO: 10011 - protein, 5 aa, Brucella spp.
DENGP

SEQ ID NO: 10012 - protein, 4 aa, Brucella spp.
NAER

SEQ ID NO: 10013 - protein, 13 aa, Brucella spp.
TEEAPAEGKPRPD

SEQ ID NO: 10014 - protein, 4 aa, Brucella spp.
TPQA

SEQ ID NO: 10015 - protein, 14 aa, Brucella spp.
VREEKGADGGEPRY

SEQ ID NO: 10016 - protein, 5 aa, Brucella spp.
RIVST

SEQ ID NO: 10017 - protein, 7 aa, Brucella spp.
FTAGTTR

SEQ ID NO: 10018 - protein, 8 aa, Brucella spp.
GYEGAGAS

SEQ ID NO: 10019 - protein, 9 aa, Brucella spp.
YGDTPGPYQ

SEQ ID NO: 10020 - protein, 4 aa, Brucella spp.
NNGL

SEQ ID NO: 10021 - protein, 8 aa, Brucella spp.
LPSPRDPF

SEQ ID NO: 10022 - protein, 22 aa, Brucella spp.
VRSKGNQLSIRGEPTATEQARR

SEQ ID NO: 10023 - protein, 18 aa, Brucella spp.
PTMENKGKLSAAQISTRK

SEQ ID NO: 10024 - protein, 8 aa, Brucella spp.
ARTPTQDA

SEQ ID NO: 10025 - protein, 8 aa, Brucella spp.
GPAGTGKT

SEQ ID NO: 10026 - protein, 6 aa, Brucella spp.
AVEAGE

SEQ ID NO: 10027 - protein, 4 aa, Brucella spp.
EKVD

SEQ ID NO: 10028 - protein, 7 aa, Brucella spp.
AQNTTSM

SEQ ID NO: 10029 - protein, 16 aa, Brucella spp.
GDPSQIDLPPGQKSGL

SEQ ID NO: 10030 - protein, 12 aa, Brucella spp.
YDRDGKQYAGPE

SEQ ID NO: 10031 - protein, 11 aa, Brucella spp.
AQETSPRANTR

SEQ ID NO: 10032 - protein, 9 aa, Brucella spp.
VATDTPDDA

SEQ ID NO: 10033 - protein, 7 aa, Brucella spp.
EKASEKL

SEQ ID NO: 10034 - protein, 10 aa, Brucella spp.
DARAADGKEL

SEQ ID NO: 10035 - protein, 6 aa, Brucella spp.
QAEGQE

SEQ ID NO: 10036 - protein, 8 aa, Brucella spp.
VRGGEKVV

SEQ ID NO: 10037 - protein, 12 aa, Brucella spp.
PAPRREETRKRG

SEQ ID NO: 10038 - protein, 8 aa, Brucella spp.
RGSEVSRS

SEQ ID NO: 10039 - protein, 7 aa, Brucella spp.
RLADSGV

SEQ ID NO: 10040 - protein, 10 aa, Brucella spp.
HGEGEDGREW

SEQ ID NO: 10041 - protein, 8 aa, Brucella spp.
TSHPRDMD

SEQ ID NO: 10042 - protein, 6 aa, Brucella spp.
QSGSDR

SEQ ID NO: 10043 - protein, 6 aa, Brucella spp.
RRHKAD

SEQ ID NO: 10044 - protein, 10 aa, Brucella spp.
PGETDQDFED

SEQ ID NO: 10045 - protein, 12 aa, Brucella spp.
YSPRPGTPGADL

SEQ ID NO: 10046 - protein, 10 aa, Brucella spp.
VEEAVKDERL

SEQ ID NO: 10047 - protein, 9 aa, Brucella spp.
KPGREAGQM

SEQ ID NO: 10048 - protein, 6 aa, Brucella spp.
NKDRVG

SEQ ID NO: 10049 - protein, 13 aa, Brucella spp.
STGTNSLIAQKLA

SEQ ID NO: 10050 - protein, 9 aa, Brucella spp.
PLGAQDSHA

SEQ ID NO: 10051 - protein, 8 aa, Brucella spp.
PQGKPNEA

SEQ ID NO: 10052 - protein, 7 aa, Brucella spp.
DVQRQGV

SEQ ID NO: 10053 - protein, 15 aa, Brucella spp.
GDRPAYYETANGRSA

SEQ ID NO: 10054 - protein, 6 aa, Brucella spp.
YDSDSG

SEQ ID NO: 10055 - protein, 6 aa, Brucella spp.
NIGKGH

SEQ ID NO: 10056 - protein, 5 aa, Brucella spp.
GPGSF

SEQ ID NO: 10057 - protein, 5 aa, Brucella spp.
AQMPE

SEQ ID NO: 10058 - protein, 8 aa, Brucella spp.
AKGVAQSA

SEQ ID NO: 10059 - protein, 18 aa, Brucella spp.
REEAEKLAAAQAENTVLT

SEQ ID NO: 10060 - protein, 8 aa, Brucella spp.
EPTAPIGT

SEQ ID NO: 10061 - protein, 10 aa, Brucella spp.
LRAPGDAPKP

SEQ ID NO: 10062 - protein, 8 aa, Brucella spp.
GPDAKPQL

SEQ ID NO: 10063 - protein, 8 aa, Brucella spp.
GGTAYGTT

SEQ ID NO: 10064 - protein, 7 aa, Brucella spp.
RLKPYPT

SEQ ID NO: 10065 - protein, 14 aa, Brucella spp.
IKDADDAGDDDTAD

SEQ ID NO: 10066 - protein, 5 aa, Brucella spp.
ASRSL

SEQ ID NO: 10067 - protein, 21 aa, Brucella spp.
TTTGGAGKTSFSDQTAATSHV

SEQ ID NO: 10068 - protein, 8 aa, Brucella spp.
YTYTPRDR

SEQ ID NO: 10069 - protein, 8 aa, Brucella spp.
NRSSPDGL

SEQ ID NO: 10070 - protein, 7 aa, Brucella spp.
SGKYPDT

SEQ ID NO: 10071 - protein, 5 aa, Brucella spp.
NQFAP

SEQ ID NO: 10072 - protein, 10 aa, Brucella spp.
MDSSTLPDVR

SEQ ID NO: 10073 - protein, 7 aa, Brucella spp.
GKRHPKL

SEQ ID NO: 10074 - protein, 22 aa, Brucella spp.
NSFYEKRNRDGSLQSPVPQEPY

SEQ ID NO: 10075 - protein, 10 aa, Brucella spp.
SPQAPSVPQE

SEQ ID NO: 10076 - protein, 8 aa, Brucella spp.
PIPTEAPT

SEQ ID NO: 10077 - protein, 16 aa, Brucella spp.
DAEHNSGLGPQARGDR

SEQ ID NO: 10078 - protein, 17 aa, Brucella spp.
RAQAQGQAQGQTQAQTQ

SEQ ID NO: 10079 - protein, 22 aa, Brucella spp.
DTSAPANSSASLGYAAADQKHV

SEQ ID NO: 10080 - protein, 4 aa, Brucella spp.
AEGY

SEQ ID NO: 10081 - protein, 4 aa, Brucella spp.
GDEA

SEQ ID NO: 10082 - protein, 7 aa, Brucella spp.
QRPETER

SEQ ID NO: 10083 - protein, 9 aa, Brucella spp.
RGEESERVR

SEQ ID NO: 10084 - protein, 4 aa, Brucella spp.
VHLG

SEQ ID NO: 10085 - protein, 18 aa, Brucella spp.
GRAADSIRTVRGAGYSFG

SEQ ID NO: 10086 - protein, 7 aa, Brucella spp.
SEREIDD

SEQ ID NO: 10087 - protein, 4 aa, Brucella spp.
GKNI

SEQ ID NO: 10088 - protein, 8 aa, Brucella spp.
VSESRQPV

SEQ ID NO: 10089 - protein, 6 aa, Brucella spp.
ASRSVQ

SEQ ID NO: 10090 - protein, 6 aa, Brucella spp.
DRDDEI

SEQ ID NO: 10091 - protein, 4 aa, Brucella spp.
ATNI

SEQ ID NO: 10092 - protein, 10 aa, Brucella spp.
PAERPKEDLS

SEQ ID NO: 10093 - protein, 16 aa, Brucella spp.
AVGEKMNATASSIKMR

SEQ ID NO: 10094 - protein, 8 aa, Brucella spp.
GPSGCGKS

SEQ ID NO: 10095 - protein, 4 aa, Brucella spp.
DIYD

SEQ ID NO: 10096 - protein, 7 aa, Brucella spp.
PNPFPKS

SEQ ID NO: 10097 - protein, 6 aa, Brucella spp.
RSKAEL

SEQ ID NO: 10098 - protein, 14 aa, Brucella spp.
LHDAGTGLSGGQQQ

SEQ ID NO: 10099 - protein, 7 aa, Brucella spp.
AARVSQR

SEQ ID NO: 10100 - protein, 15 aa, Brucella spp.
PTEKRTQDYITGRFG

SEQ ID NO: 10101 - protein, 6 aa, Brucella spp.
QPPRRD

SEQ ID NO: 10102 - protein, 12 aa, Brucella spp.
IDPGNKHETDPN

SEQ ID NO: 10103 - protein, 8 aa, Brucella spp.
ARTDRPAM

SEQ ID NO: 10104 - protein, 5 aa, Brucella spp.
LIGTT

SEQ ID NO: 10105 - protein, 6 aa, Brucella spp.
IDSAFK

SEQ ID NO: 10106 - protein, 12 aa, Brucella spp.
VPETNRKVSDRQ

SEQ ID NO: 10107 - protein, 10 aa, Brucella spp.
ASSRPETSGL

SEQ ID NO: 10108 - protein, 6 aa, Brucella spp.
VPPSIR

SEQ ID NO: 10109 - protein, 6 aa, Brucella spp.
GLGASK

SEQ ID NO: 10110 - protein, 12 aa, Brucella spp.
PATPMDPSTARP

SEQ ID NO: 10111 - protein, 16 aa, Brucella spp.
FAAASGPAGEKMHSRP

SEQ ID NO: 10112 - protein, 7 aa, Brucella spp.
EGSYTNR

SEQ ID NO: 10113 - protein, 6 aa, Brucella spp.
AALAAK

SEQ ID NO: 10114 - protein, 7 aa, Brucella spp.
LATEGQD

SEQ ID NO: 10115 - protein, 9 aa, Brucella spp.
AAGSGGQVG

SEQ ID NO: 10116 - protein, 4 aa, Brucella spp.
SPRV

SEQ ID NO: 10117 - protein, 16 aa, Brucella spp.
LRDGSLGLGATRSETI

SEQ ID NO: 10118 - protein, 5 aa, Brucella spp.
FNSPQ

SEQ ID NO: 10119 - protein, 7 aa, Brucella spp.
AAQARDQ

SEQ ID NO: 10120 - protein, 6 aa, Brucella spp.
GETYPN

SEQ ID NO: 10121 - protein, 11 aa, Brucella spp.
VVESGGSGAGI

SEQ ID NO: 10122 - protein, 6 aa, Brucella spp.
VGENTI

SEQ ID NO: 10123 - protein, 10 aa, Brucella spp.
ASRAMKDSEL

SEQ ID NO: 10124 - protein, 8 aa, Brucella spp.
DAKGPDWK

SEQ ID NO: 10125 - protein, 9 aa, Brucella spp.
VDNPNTKWN

SEQ ID NO: 10126 - protein, 5 aa, Brucella spp.
NPNLP

SEQ ID NO: 10127 - protein, 10 aa, Brucella spp.
PGEKHGTREV

SEQ ID NO: 10128 - protein, 7 aa, Brucella spp.
CKHSGAL

SEQ ID NO: 10129 - protein, 12 aa, Brucella spp.
RKTGLDDKAAAS

SEQ ID NO: 10130 - protein, 14 aa, Brucella spp.
KDGKAVDIDGDYAE

SEQ ID NO: 10131 - protein, 7 aa, Brucella spp.
ASNKTGV

SEQ ID NO: 10132 - protein, 17 aa, Brucella spp.
NGVKPSAETVASGEYPV

SEQ ID NO: 10133 - protein, 9 aa, Brucella spp.
IGPDGPLAE

SEQ ID NO: 10134 - protein, 23 aa, Brucella spp.
PAPDAEREAQRTAFSEGKTLAAK

SEQ ID NO: 10135 - protein, 5 aa, Brucella spp.
AQKRG

SEQ ID NO: 10136 - protein, 6 aa, Brucella spp.
KGDHYT

SEQ ID NO: 10137 - protein, 4 aa, Brucella spp.
VRNS

SEQ ID NO: 10138 - protein, 5 aa, Brucella spp.
KDPQE

SEQ ID NO: 10139 - protein, 6 aa, Brucella spp.
YGNGGA

SEQ ID NO: 10140 - protein, 5 aa, Brucella spp.
GDRNL

SEQ ID NO: 10141 - protein, 5 aa, Brucella spp.
VRAGD

SEQ ID NO: 10142 - protein, 5 aa, Brucella spp.
EPVGA

SEQ ID NO: 10143 - protein, 11 aa, Brucella spp.
RVPSETDARSN

SEQ ID NO: 10144 - protein, 14 aa, Brucella spp.
GGRPEQSKLTPRER

SEQ ID NO: 10145 - protein, 4 aa, Brucella spp.
PSLK

SEQ ID NO: 10146 - protein, 7 aa, Brucella spp.
VTSPTGI

SEQ ID NO: 10147 - protein, 5 aa, Brucella spp.
GPKAV

SEQ ID NO: 10148 - protein, 5 aa, Brucella spp.
SSITA

SEQ ID NO: 10149 - protein, 4 aa, Brucella spp.
PGTG

SEQ ID NO: 10150 - protein, 8 aa, Brucella spp.
LGDRKGQK

SEQ ID NO: 10151 - protein, 10 aa, Brucella spp.
LPPVPAGRGN

SEQ ID NO: 10152 - protein, 15 aa, Brucella spp.
NAKVIENAEGARTTP

SEQ ID NO: 10153 - protein, 22 aa, Brucella spp.
DGDERLAGQPAKRQAVTNPEGT

SEQ ID NO: 10154 - protein, 5 aa, Brucella spp.
DPMVT

SEQ ID NO: 10155 - protein, 7 aa, Brucella spp.
KGDNGDA

SEQ ID NO: 10156 - protein, 8 aa, Brucella spp.
KKYSPSQI

SEQ ID NO: 10157 - protein, 8 aa, Brucella spp.
KETAESYL

SEQ ID NO: 10158 - protein, 13 aa, Brucella spp.
AQRQATKDAGKIA

SEQ ID NO: 10159 - protein, 5 aa, Brucella spp.
EPTAA

SEQ ID NO: 10160 - protein, 9 aa, Brucella spp.
LDKSEGKTI

SEQ ID NO: 10161 - protein, 9 aa, Brucella spp.
KSTNGDTFL

SEQ ID NO: 10162 - protein, 8 aa, Brucella spp.
KESGIDLK

SEQ ID NO: 10163 - protein, 18 aa, Brucella spp.
KEAAEKAKIELSSSQQTE

SEQ ID NO: 10164 - protein, 7 aa, Brucella spp.
DQTGPKH

SEQ ID NO: 10165 - protein, 11 aa, Brucella spp.
LKDAGLKAGEI

SEQ ID NO: 10166 - protein, 11 aa, Brucella spp.
KEPHKGVNPDE

SEQ ID NO: 10167 - protein, 21 aa, Brucella spp.
NTTIPTKKSQTFSTAEDNQSA

SEQ ID NO: 10168 - protein, 7 aa, Brucella spp.
EREMAAD

SEQ ID NO: 10169 - protein, 8 aa, Brucella spp.
PPAPRGVP

SEQ ID NO: 10170 - protein, 10 aa, Brucella spp.
AKDKGTGKEH

SEQ ID NO: 10171 - protein, 9 aa, Brucella spp.
ASGGLSDAD

SEQ ID NO: 10172 - protein, 25 aa, Brucella spp.
DAEANAEADKKRRESVEAKNQAESL

SEQ ID NO: 10173 - protein, 23 aa, Brucella spp.
STEKSLAEYGDKVSADDKKAIED

SEQ ID NO: 10174 - protein, 18 aa, Brucella spp.
TSLEGEDAEDIKAKTQAL

SEQ ID NO: 10175 - protein, 24 aa, Brucella spp.
AQAAEGAGAEGGEQASSSKDDVVD

SEQ ID NO: 10176 - protein, 5 aa, Brucella spp.
ETDAT

SEQ ID NO: 10177 - protein, 5 aa, Brucella spp.
SVDDR

SEQ ID NO: 10178 - protein, 8 aa, Brucella spp.
TRHPDADK

SEQ ID NO: 10179 - protein, 8 aa, Brucella spp.
DTGDGKPV

SEQ ID NO: 10180 - protein, 7 aa, Brucella spp.
APNARAG

SEQ ID NO: 10181 - protein, 6 aa, Brucella spp.
RPGDYV

SEQ ID NO: 10182 - protein, 6 aa, Brucella spp.
NAPVGT

SEQ ID NO: 10183 - protein, 8 aa, Brucella spp.
TPNRADCT

SEQ ID NO: 10184 - protein, 4 aa, Brucella spp.
AGLG

SEQ ID NO: 10185 - protein, 15 aa, Brucella spp.
NTLPDAVKGEGETPV

SEQ ID NO: 10186 - protein, 6 aa, Brucella spp.
DAGNPF

SEQ ID NO: 10187 - protein, 9 aa, Brucella spp.
VKNGPSPKW

SEQ ID NO: 10188 - protein, 5 aa, Brucella spp.
VKGNL

SEQ ID NO: 10189 - protein, 8 aa, Brucella spp.
RTARDGET

SEQ ID NO: 10190 - protein, 7 aa, Brucella spp.
ENGPESI

SEQ ID NO: 10191 - protein, 8 aa, Brucella spp.
EHSGCDEN

SEQ ID NO: 10192 - protein, 4 aa, Brucella spp.
GQPT

SEQ ID NO: 10193 - protein, 4 aa, Brucella spp.
KPHT

SEQ ID NO: 10194 - protein, 10 aa, Brucella spp.
VEGDGKTIRA

SEQ ID NO: 10195 - protein, 9 aa, Brucella spp.
RGDVEGKAD

SEQ ID NO: 10196 - protein, 11 aa, Brucella spp.
DPQPLPSHGAV

SEQ ID NO: 10197 - protein, 11 aa, Brucella spp.
AKAFGGGKPEL

SEQ ID NO: 10198 - protein, 9 aa, Brucella spp.
AQRNADRGF

SEQ ID NO: 10199 - protein, 27 aa, Brucella spp.
YEGDTPDKQRRVAGGVRRGTAKVEGAG

SEQ ID NO: 10200 - protein, 7 aa, Brucella spp.
AAGAPVD

SEQ ID NO: 10201 - protein, 6 aa, Brucella spp.
EAGGPE

SEQ ID NO: 10202 - protein, 9 aa, Brucella spp.
PGRSGTLKL

SEQ ID NO: 10203 - protein, 15 aa, Brucella spp.
IPEPKAKSARTKPAL

SEQ ID NO: 10204 - protein, 4 aa, Brucella spp.
EAGN

SEQ ID NO: 10205 - protein, 7 aa, Brucella spp.
AVSSADK

SEQ ID NO: 10206 - protein, 9 aa, Brucella spp.
SLGEGKKSI

SEQ ID NO: 10207 - protein, 8 aa, Brucella spp.
QDRTLTDE

SEQ ID NO: 10208 - protein, 6 aa, Brucella spp.
VDEQGI

SEQ ID NO: 10209 - protein, 9 aa, Brucella spp.
GKKGTVSEK

SEQ ID NO: 10210 - protein, 17 aa, Brucella spp.
LGGMSPEERQMQGPAIN

SEQ ID NO: 10211 - protein, 12 aa, Brucella spp.
VTEALSERRTEL

SEQ ID NO: 10212 - protein, 10 aa, Brucella spp.
RESAASRGRI

SEQ ID NO: 10213 - protein, 7 aa, Brucella spp.
EGPDIET

SEQ ID NO: 10214 - protein, 8 aa, Brucella spp.
PEGHPARE

SEQ ID NO: 10215 - protein, 8 aa, Brucella spp.
PDEKGERK

SEQ ID NO: 10216 - protein, 4 aa, Brucella spp.
HTSP

SEQ ID NO: 10217 - protein, 9 aa, Brucella spp.
RDKEGRDEP

SEQ ID NO: 10218 - protein, 11 aa, Brucella spp.
TYRMDSDATHS

SEQ ID NO: 10219 - protein, 4 aa, Brucella spp.
SANV

SEQ ID NO: 10220 - protein, 7 aa, Brucella spp.
DRSGPHV

SEQ ID NO: 10221 - protein, 5 aa, Brucella spp.
YDPEV

SEQ ID NO: 10222 - protein, 7 aa, Brucella spp.
ESRGRRI

SEQ ID NO: 10223 - protein, 6 aa, Brucella spp.
AQSRPF

SEQ ID NO: 10224 - protein, 19 aa, Brucella spp.
SPKETNPAGMAEREKRKAQ

SEQ ID NO: 10225 - protein, 8 aa, Brucella spp.
KENAQEHD

SEQ ID NO: 10226 - protein, 4 aa, Brucella spp.
KAHA

SEQ ID NO: 10227 - protein, 5 aa, Brucella spp.
GRPHP

SEQ ID NO: 10228 - protein, 4 aa, Brucella spp.
EEPE

SEQ ID NO: 10229 - protein, 8 aa, Brucella spp.
RFSKTPHR

SEQ ID NO: 10230 - protein, 8 aa, Brucella spp.
RAAAPADV

SEQ ID NO: 10231 - protein, 35 aa, Brucella spp.
AGFRGRRKNTIRTAKAAVDRSKQYAYRDRKNRKRS

SEQ ID NO: 10232 - protein, 4 aa, Brucella spp.
REQG

SEQ ID NO: 10233 - protein, 4 aa, Brucella spp.
KKAL

SEQ ID NO: 10234 - protein, 12 aa, Brucella spp.
TSMPNAFEGAVR

SEQ ID NO: 10235 - protein, 6 aa, Brucella spp.
QSTGSL

SEQ ID NO: 10236 - protein, 15 aa, Brucella spp.
RKSAEIVQSGPYSVT

SEQ ID NO: 10237 - protein, 7 aa, Brucella spp.
IGAQTGS

SEQ ID NO: 10238 - protein, 5 aa, Brucella spp.
NAEPP

SEQ ID NO: 10239 - protein, 19 aa, Brucella spp.
KYQNQKKAAEARKKQKTVE

SEQ ID NO: 10240 - protein, 4 aa, Brucella spp.
EDTV

SEQ ID NO: 10241 - protein, 19 aa, Brucella spp.
VESEPKLEGRQMMMVLAPR

SEQ ID NO: 10242 - protein, 10 aa, Brucella spp.
LGSTQAETAS

SEQ ID NO: 10243 - protein, 4 aa, Brucella spp.
TVSI

SEQ ID NO: 10244 - protein, 11 aa, Brucella spp.
GRSPALPAPEI

SEQ ID NO: 10245 - protein, 4 aa, Brucella spp.
QNLP

SEQ ID NO: 10246 - protein, 8 aa, Brucella spp.
SGYEPPTS

SEQ ID NO: 10247 - protein, 9 aa, Brucella spp.
PLGASTTNL

SEQ ID NO: 10248 - protein, 10 aa, Brucella spp.
TNPDAHPDHS

SEQ ID NO: 10249 - protein, 4 aa, Brucella spp.
EHER

SEQ ID NO: 10250 - protein, 10 aa, Brucella spp.
NFGTTGNAAF

SEQ ID NO: 10251 - protein, 13 aa, Brucella spp.
AEERRKLEEARAE

SEQ ID NO: 10252 - protein, 9 aa, Brucella spp.
RRARDKEEF

SEQ ID NO: 10253 - protein, 20 aa, Brucella spp.
HSNAKKTPAARGKTGSKGDA

SEQ ID NO: 10254 - protein, 13 aa, Brucella spp.
NRTPAGSAAVRSE

SEQ ID NO: 10255 - protein, 6 aa, Brucella spp.
ENPRAK

SEQ ID NO: 10256 - protein, 6 aa, Brucella spp.
EPGGKG

SEQ ID NO: 10257 - protein, 7 aa, Brucella spp.
PGLPERE

SEQ ID NO: 10258 - protein, 8 aa, Brucella spp.
LPDQPGVR

SEQ ID NO: 10259 - protein, 5 aa, Brucella spp.
PGRGT

SEQ ID NO: 10260 - protein, 5 aa, Brucella spp.
PSHLP

SEQ ID NO: 10261 - protein, 7 aa, Brucella spp.
AVGRKAK

SEQ ID NO: 10262 - protein, 12 aa, Brucella spp.
DTKSRWGSCTSD

SEQ ID NO: 10263 - protein, 4 aa, Brucella spp.
PDTE

SEQ ID NO: 10264 - protein, 9 aa, Brucella spp.
YDPRVAERA

SEQ ID NO: 10265 - protein, 9 aa, Brucella spp.
RSGRGTDKL

SEQ ID NO: 10266 - protein, 8 aa, Brucella spp.
YKASEAEA

SEQ ID NO: 10267 - protein, 7 aa, Brucella spp.
NATNIGE

SEQ ID NO: 10268 - protein, 7 aa, Brucella spp.
KPQTQRR

SEQ ID NO: 10269 - protein, 6 aa, Brucella spp.
ARASIS

SEQ ID NO: 10270 - protein, 7 aa, Brucella spp.
EEQPTAE

SEQ ID NO: 10271 - protein, 5 aa, Brucella spp.
TPEAV

SEQ ID NO: 10272 - protein, 7 aa, Brucella spp.
ALDGGAT

SEQ ID NO: 10273 - protein, 8 aa, Brucella spp.
PRHITPDA

SEQ ID NO: 10274 - protein, 8 aa, Brucella spp.
RAAATGRA

SEQ ID NO: 10275 - protein, 7 aa, Brucella spp.
DADDEAL

SEQ ID NO: 10276 - protein, 7 aa, Brucella spp.
GGETPER

SEQ ID NO: 10277 - protein, 14 aa, Brucella spp.
AKPPKGSELPGGNG

SEQ ID NO: 10278 - protein, 6 aa, Brucella spp.
LNADNI

SEQ ID NO: 10279 - protein, 8 aa, Brucella spp.
TGAPGIDI

SEQ ID NO: 10280 - protein, 9 aa, Brucella spp.
VECAPGEKD

SEQ ID NO: 10281 - protein, 23 aa, Brucella spp.
DGAETLNKPVAPNSYKTGPDEEG

SEQ ID NO: 10282 - protein, 12 aa, Brucella spp.
AYETAKNDPEFK

SEQ ID NO: 10283 - protein, 6 aa, Brucella spp.
AGRPSK

SEQ ID NO: 10284 - protein, 4 aa, Brucella spp.
KHLG

SEQ ID NO: 10285 - protein, 7 aa, Brucella spp.
LNHTGSH

SEQ ID NO: 10286 - protein, 12 aa, Brucella spp.
ETGAGQHGVASA

SEQ ID NO: 10287 - protein, 9 aa, Brucella spp.
SDVERQKPN

SEQ ID NO: 10288 - protein, 14 aa, Brucella spp.
VKPVSAGNGTLKDA

SEQ ID NO: 10289 - protein, 7 aa, Brucella spp.
AGPHPYP

SEQ ID NO: 10290 - protein, 5 aa, Brucella spp.
GTEAR

SEQ ID NO: 10291 - protein, 5 aa, Brucella spp.
QEGRL

SEQ ID NO: 10292 - protein, 6 aa, Brucella spp.
GGGSNA

SEQ ID NO: 10293 - protein, 11 aa, Brucella spp.
AGGRGLEGEEH

SEQ ID NO: 10294 - protein, 8 aa, Brucella spp.
MSAGRPGV

SEQ ID NO: 10295 - protein, 13 aa, Brucella spp.
SAGLDYPGVGPEH

SEQ ID NO: 10296 - protein, 5 aa, Brucella spp.
DSGRV

SEQ ID NO: 10297 - protein, 5 aa, Brucella spp.
APTMG

SEQ ID NO: 10298 - protein, 19 aa, Brucella spp.
SGRGDKDVHTVGKLLGMDI

SEQ ID NO: 10299 - protein, 4 aa, Brucella spp.
CGPA

SEQ ID NO: 10300 - protein, 9 aa, Brucella spp.
ADPANPVAE

SEQ ID NO: 10301 - protein, 13 aa, Brucella spp.
ASAAAKLADTPHM

SEQ ID NO: 10302 - protein, 5 aa, Brucella spp.
GKPVA

SEQ ID NO: 10303 - protein, 7 aa, Brucella spp.
KAEGRPA

SEQ ID NO: 10304 - protein, 6 aa, Brucella spp.
DPDLET

SEQ ID NO: 10305 - protein, 5 aa, Brucella spp.
PKAGA

SEQ ID NO: 10306 - protein, 10 aa, Brucella spp.
PMADGPAIQA

SEQ ID NO: 10307 - protein, 6 aa, Brucella spp.
NAGQTL

SEQ ID NO: 10308 - protein, 8 aa, Brucella spp.
RKEDDTTP

SEQ ID NO: 10309 - protein, 7 aa, Brucella spp.
AKASGVD

SEQ ID NO: 10310 - protein, 9 aa, Brucella spp.
TPTTDDKRL

SEQ ID NO: 10311 - protein, 9 aa, Brucella spp.
ADTAKVGEA

SEQ ID NO: 10312 - protein, 5 aa, Brucella spp.
KSTDL

SEQ ID NO: 10313 - protein, 7 aa, Brucella spp.
KTPEQAA

SEQ ID NO: 10314 - protein, 16 aa, Brucella spp.
GELDEKGKAKGDPVAA

SEQ ID NO: 10315 - protein, 6 aa, Brucella spp.
DPSTGE

SEQ ID NO: 10316 - protein, 6 aa, Brucella spp.
EYTTLE

SEQ ID NO: 10317 - protein, 5 aa, Brucella spp.
PKVPL

SEQ ID NO: 10318 - protein, 8 aa, Brucella spp.
YRSRTGMD

SEQ ID NO: 10319 - protein, 4 aa, Brucella spp.
GMGA

SEQ ID NO: 10320 - protein, 7 aa, Brucella spp.
SGGARMQ

SEQ ID NO: 10321 - protein, 8 aa, Brucella spp.
NPTTGGVT

SEQ ID NO: 10322 - protein, 7 aa, Brucella spp.
LPEGFQS

SEQ ID NO: 10323 - protein, 21 aa, Brucella spp.
KQPANSDAPAPQKPDADSKAA

SEQ ID NO: 10324 - protein, 10 aa, Brucella spp.
GTNGKGSATA

SEQ ID NO: 10325 - protein, 9 aa, Brucella spp.
AAPGGGKLV

SEQ ID NO: 10326 - protein, 8 aa, Brucella spp.
AAANGGQH

SEQ ID NO: 10327 - protein, 5 aa, Brucella spp.
APPAS

SEQ ID NO: 10328 - protein, 7 aa, Brucella spp.
GHNPGAG

SEQ ID NO: 10329 - protein, 6 aa, Brucella spp.
LEERNA

SEQ ID NO: 10330 - protein, 5 aa, Brucella spp.
TKDPV

SEQ ID NO: 10331 - protein, 11 aa, Brucella spp.
IPSSDAGIANT

SEQ ID NO: 10332 - protein, 12 aa, Brucella spp.
SAEKAGLSAEPV

SEQ ID NO: 10333 - protein, 8 aa, Brucella spp.
PADEAPPR

SEQ ID NO: 10334 - protein, 5 aa, Brucella spp.
TRNRP

SEQ ID NO: 10335 - protein, 5 aa, Brucella spp.
EAEPN

SEQ ID NO: 10336 - protein, 12 aa, Brucella spp.
DQETGYEGKGDF

SEQ ID NO: 10337 - protein, 7 aa, Brucella spp.
AEGRLRR

SEQ ID NO: 10338 - protein, 6 aa, Brucella spp.
RDVPGE

SEQ ID NO: 10339 - protein, 6 aa, Brucella spp.
ATPGIA

SEQ ID NO: 10340 - protein, 16 aa, Brucella spp.
TPEAIGKAEAVLSAFA

SEQ ID NO: 10341 - protein, 10 aa, Brucella spp.
DLGAGKSSLA

SEQ ID NO: 10342 - protein, 10 aa, Brucella spp.
DAGLDVPSPT

SEQ ID NO: 10343 - protein, 7 aa, Brucella spp.
STPEELD

SEQ ID NO: 10344 - protein, 7 aa, Brucella spp.
WPEQGEG

SEQ ID NO: 10345 - protein, 4 aa, Brucella spp.
EGAG

SEQ ID NO: 10346 - protein, 6 aa, Brucella spp.
QQPAME

SEQ ID NO: 10347 - protein, 7 aa, Brucella spp.
NGRVEAR

SEQ ID NO: 10348 - protein, 10 aa, Brucella spp.
QGDASPRKYE

SEQ ID NO: 10349 - protein, 14 aa, Brucella spp.
MPYDPPLRDGKSYR

SEQ ID NO: 10350 - protein, 4 aa, Brucella spp.
GSDL

SEQ ID NO: 10351 - protein, 17 aa, Brucella spp.
GTEGVRAASGEPIPERY

SEQ ID NO: 10352 - protein, 9 aa, Brucella spp.
LNDAEREAF

SEQ ID NO: 10353 - protein, 5 aa, Brucella spp.
ADSEK

SEQ ID NO: 10354 - protein, 6 aa, Brucella spp.
AQGKDK

SEQ ID NO: 10355 - protein, 5 aa, Brucella spp.
VSPEL

SEQ ID NO: 10356 - protein, 6 aa, Brucella spp.
MGAQRN

SEQ ID NO: 10357 - protein, 8 aa, Brucella spp.
ERDGKPAY

SEQ ID NO: 10358 - protein, 15 aa, Brucella spp.
EEFGKSQPLKGARIS

SEQ ID NO: 10359 - protein, 4 aa, Brucella spp.
QDHA

SEQ ID NO: 10360 - protein, 7 aa, Brucella spp.
IAATGTP

SEQ ID NO: 10361 - protein, 7 aa, Brucella spp.
PDGEPSN

SEQ ID NO: 10362 - protein, 5 aa, Brucella spp.
DGGDA

SEQ ID NO: 10363 - protein, 17 aa, Brucella spp.
RAEAGEDVLSNPQSEEE

SEQ ID NO: 10364 - protein, 6 aa, Brucella spp.
MAATPG

SEQ ID NO: 10365 - protein, 13 aa, Brucella spp.
AIKGVTEETTTGV

SEQ ID NO: 10366 - protein, 16 aa, Brucella spp.
NDSVTKSKFDNKYGCK

SEQ ID NO: 10367 - protein, 4 aa, Brucella spp.
IRRG

SEQ ID NO: 10368 - protein, 16 aa, Brucella spp.
DVGKGSAQSLAGAGAR

SEQ ID NO: 10369 - protein, 6 aa, Brucella spp.
DAASTA

SEQ ID NO: 10370 - protein, 7 aa, Brucella spp.
TTTGNKD

SEQ ID NO: 10371 - protein, 7 aa, Brucella spp.
NATGHPS

SEQ ID NO: 10372 - protein, 5 aa, Brucella spp.
TDAYK

SEQ ID NO: 10373 - protein, 13 aa, Brucella spp.
TPQGPFKSEHYRY

SEQ ID NO: 10374 - protein, 7 aa, Brucella spp.
DPDNAVS

SEQ ID NO: 10375 - protein, 5 aa, Brucella spp.
LHARA

SEQ ID NO: 10376 - protein, 8 aa, Brucella spp.
KDGMTVGG

SEQ ID NO: 10377 - protein, 8 aa, Brucella spp.
ASGEQADA

SEQ ID NO: 10378 - protein, 5 aa, Brucella spp.
GPQEN

SEQ ID NO: 10379 - protein, 9 aa, Brucella spp.
EDDMEQRRR

SEQ ID NO: 10380 - protein, 7 aa, Brucella spp.
ERADSGR

SEQ ID NO: 10381 - protein, 6 aa, Brucella spp.
GGTPSN

SEQ ID NO: 10382 - protein, 4 aa, Brucella spp.
ISGD

SEQ ID NO: 10383 - protein, 11 aa, Brucella spp.
ALREAQDAGRK

SEQ ID NO: 10384 - protein, 7 aa, Brucella spp.
SGAGKTE

SEQ ID NO: 10385 - protein, 7 aa, Brucella spp.
AASRREE

SEQ ID NO: 10386 - protein, 9 aa, Brucella spp.
DEAERYPGK

SEQ ID NO: 10387 - protein, 11 aa, Brucella spp.
SANGDSNALSR

SEQ ID NO: 10388 - protein, 11 aa, Brucella spp.
GMRERRARRQR

SEQ ID NO: 10389 - protein, 4 aa, Brucella spp.
VTVD

SEQ ID NO: 10390 - protein, 13 aa, Brucella spp.
GQSITPSPDSPDN

SEQ ID NO: 10391 - protein, 4 aa, Brucella spp.
EKVS

SEQ ID NO: 10392 - protein, 7 aa, Brucella spp.
SPTSTRA

SEQ ID NO: 10393 - protein, 8 aa, Brucella spp.
TSFPSSGP

SEQ ID NO: 10394 - protein, 7 aa, Brucella spp.
PIEDETP

SEQ ID NO: 10395 - protein, 9 aa, Brucella spp.
QEQPGGNGL

SEQ ID NO: 10396 - protein, 16 aa, Brucella spp.
LSGSPQMAQRRNQRGE

SEQ ID NO: 10397 - protein, 7 aa, Brucella spp.
TEGDDID

SEQ ID NO: 10398 - protein, 10 aa, Brucella spp.
SAAADRVRHG

SEQ ID NO: 10399 - protein, 9 aa, Brucella spp.
FSERQDEVG

SEQ ID NO: 10400 - protein, 7 aa, Brucella spp.
KNPLTSL

SEQ ID NO: 10401 - protein, 8 aa, Brucella spp.
AKTDESRK

SEQ ID NO: 10402 - protein, 8 aa, Brucella spp.
SDASRLDA

SEQ ID NO: 10403 - protein, 9 aa, Brucella spp.
REVRRNKVG

SEQ ID NO: 10404 - protein, 7 aa, Brucella spp.
KLPTGKK

SEQ ID NO: 10405 - protein, 7 aa, Brucella spp.
FVPDDTG

SEQ ID NO: 10406 - protein, 4 aa, Brucella spp.
GEGN

SEQ ID NO: 10407 - protein, 7 aa, Brucella spp.
DNGPGIP

SEQ ID NO: 10408 - protein, 15 aa, Brucella spp.
DRPASEAFGQNSGLG

SEQ ID NO: 10409 - protein, 17 aa, Brucella spp.
GGTLTAENITDPDKPDI

SEQ ID NO: 10410 - protein, 6 aa, Brucella spp.
ESEGYR

SEQ ID NO: 10411 - protein, 10 aa, Brucella spp.
ETYTDGASAL

SEQ ID NO: 10412 - protein, 6 aa, Brucella spp.
KDDEID

SEQ ID NO: 10413 - protein, 19 aa, Brucella spp.
ARDGTAKPAGQQAKSLERG

SEQ ID NO: 10414 - protein, 6 aa, Brucella spp.
QRPGVV

SEQ ID NO: 10415 - protein, 8 aa, Brucella spp.
SISTSGLK

SEQ ID NO: 10416 - protein, 12 aa, Brucella spp.
IRRGEAELSAQG

SEQ ID NO: 10417 - protein, 13 aa, Brucella spp.
RTGQHTGRSPKDK

SEQ ID NO: 10418 - protein, 6 aa, Brucella spp.
DANTED

SEQ ID NO: 10419 - protein, 6 aa, Brucella spp.
KPMTPE

SEQ ID NO: 10420 - protein, 10 aa, Brucella spp.
GGADADNKIN

SEQ ID NO: 10421 - protein, 5 aa, Brucella spp.
PSQEA

SEQ ID NO: 10422 - protein, 10 aa, Brucella spp.
FKADPERYGV

SEQ ID NO: 10423 - protein, 7 aa, Brucella spp.
TSYAGEM

SEQ ID NO: 10424 - protein, 9 aa, Brucella spp.
ANEGPNGDT

SEQ ID NO: 10425 - protein, 15 aa, Brucella spp.
GTGKTTLSADPTRTL

SEQ ID NO: 10426 - protein, 6 aa, Brucella spp.
DEHGWG

SEQ ID NO: 10427 - protein, 8 aa, Brucella spp.
SAEAEPEI

SEQ ID NO: 10428 - protein, 17 aa, Brucella spp.
ENRQPDFDDGSLTENTR

SEQ ID NO: 10429 - protein, 12 aa, Brucella spp.
NASKSGKGGQPK

SEQ ID NO: 10430 - protein, 4 aa, Brucella spp.
LTPA

SEQ ID NO: 10431 - protein, 15 aa, Brucella spp.
KVAATEKGVTEPEAT

SEQ ID NO: 10432 - protein, 6 aa, Brucella spp.
HPSEYG

SEQ ID NO: 10433 - protein, 7 aa, Brucella spp.
WTGGAYG

SEQ ID NO: 10434 - protein, 6 aa, Brucella spp.
DGSLNN

SEQ ID NO: 10435 - protein, 13 aa, Brucella spp.
PGVESSILDPRST

SEQ ID NO: 10436 - protein, 14 aa, Brucella spp.
ASGPGGQNVNKVST

SEQ ID NO: 10437 - protein, 6 aa, Brucella spp.
RSGLPE

SEQ ID NO: 10438 - protein, 9 aa, Brucella spp.
GQKGTKDGD

SEQ ID NO: 10439 - protein, 12 aa, Brucella spp.
RTQERNREDARE

SEQ ID NO: 10440 - protein, 20 aa, Brucella spp.
AAEPPPPPRKKTKPSRGAVE

SEQ ID NO: 10441 - protein, 20 aa, Brucella spp.
LKAKSGRSEIKKGRGKVSFD

SEQ ID NO: 10442 - protein, 6 aa, Brucella spp.
AVGKST

SEQ ID NO: 10443 - protein, 7 aa, Brucella spp.
WPSSPKV

SEQ ID NO: 10444 - protein, 6 aa, Brucella spp.
GFPESY

SEQ ID NO: 10445 - protein, 5 aa, Brucella spp.
LPEDG

SEQ ID NO: 10446 - protein, 4 aa, Brucella spp.
AFRD

SEQ ID NO: 10447 - protein, 10 aa, Brucella spp.
LSQEAARSIA

SEQ ID NO: 10448 - protein, 6 aa, Brucella spp.
LPTRPR

SEQ ID NO: 10449 - protein, 15 aa, Brucella spp.
GDPVEAARAYDAAGA

SEQ ID NO: 10450 - protein, 8 aa, Brucella spp.
ASSDNRET

SEQ ID NO: 10451 - protein, 6 aa, Brucella spp.
VSINTA

SEQ ID NO: 10452 - protein, 6 aa, Brucella spp.
VKNPEF

SEQ ID NO: 10453 - protein, 4 aa, Brucella spp.
DKFG

SEQ ID NO: 10454 - protein, 10 aa, Brucella spp.
KKVSGAGEND

SEQ ID NO: 10455 - protein, 7 aa, Brucella spp.
GRQPTGI

SEQ ID NO: 10456 - protein, 10 aa, Brucella spp.
DRDGTKAGYD

SEQ ID NO: 10457 - protein, 6 aa, Brucella spp.
SGGVGT

SEQ ID NO: 10458 - protein, 4 aa, Brucella spp.
DGHA

SEQ ID NO: 10459 - protein, 14 aa, Brucella spp.
NEDPAAQAKAFEDQ

SEQ ID NO: 10460 - protein, 10 aa, Brucella spp.
FAGESVNGTA

SEQ ID NO: 10461 - protein, 8 aa, Brucella spp.
TKNPVQLG

SEQ ID NO: 10462 - protein, 8 aa, Brucella spp.
DAKGGKVA

SEQ ID NO: 10463 - protein, 5 aa, Brucella spp.
FEGAG

SEQ ID NO: 10464 - protein, 6 aa, Brucella spp.
GAISGR

SEQ ID NO: 10465 - protein, 16 aa, Brucella spp.
GRIDPAEALSVLRAAA

SEQ ID NO: 10466 - protein, 19 aa, Brucella spp.
NLRSATKAFERAAHESGIS

SEQ ID NO: 10467 - protein, 5 aa, Brucella spp.
QRVAS

SEQ ID NO: 10468 - protein, 7 aa, Brucella spp.
LEKTVTN

SEQ ID NO: 10469 - protein, 5 aa, Brucella spp.
VPSDA

SEQ ID NO: 10470 - protein, 7 aa, Brucella spp.
IPTGDDG

SEQ ID NO: 10471 - protein, 6 aa, Brucella spp.
KNASDV

SEQ ID NO: 10472 - protein, 14 aa, Brucella spp.
DYGGDVTAAVGRDN

SEQ ID NO: 10473 - protein, 6 aa, Brucella spp.
FHPEKS

SEQ ID NO: 10474 - protein, 17 aa, Brucella spp.
AEAFSGEAGTGSPSEKA

SEQ ID NO: 10475 - protein, 4 aa, Brucella spp.
TSLG

SEQ ID NO: 10476 - protein, 4 aa, Brucella spp.
RQGY

SEQ ID NO: 10477 - protein, 13 aa, Brucella spp.
GVETASADIPVPQ

SEQ ID NO: 10478 - protein, 11 aa, Brucella spp.
QVSRPAPSTFG

SEQ ID NO: 10479 - protein, 7 aa, Brucella spp.
DGQVSLG

SEQ ID NO: 10480 - protein, 12 aa, Brucella spp.
KGNARKVRRIGK

SEQ ID NO: 10481 - protein, 5 aa, Brucella spp.
GATAD

SEQ ID NO: 10482 - protein, 5 aa, Brucella spp.
EQYPD

SEQ ID NO: 10483 - protein, 12 aa, Brucella spp.
LTGTGDVLEPEQ

SEQ ID NO: 10484 - protein, 7 aa, Brucella spp.
GSGGNYA

SEQ ID NO: 10485 - protein, 10 aa, Brucella spp.
ETDKSAEEIA

SEQ ID NO: 10486 - protein, 6 aa, Brucella spp.
KDAKRA

SEQ ID NO: 10487 - protein, 4 aa, Brucella spp.
LEGQ

SEQ ID NO: 10488 - protein, 9 aa, Brucella spp.
TGVGKTEIS

SEQ ID NO: 10489 - protein, 8 aa, Brucella spp.
KRREDVKA

SEQ ID NO: 10490 - protein, 6 aa, Brucella spp.
AHLNAE

SEQ ID NO: 10491 - protein, 10 aa, Brucella spp.
KTASPVTRDS

SEQ ID NO: 10492 - protein, 9 aa, Brucella spp.
LRNGEMDDK

SEQ ID NO: 10493 - protein, 10 aa, Brucella spp.
SDSGASPNFE

SEQ ID NO: 10494 - protein, 15 aa, Brucella spp.
MGGRTKTRKTTVKDS

SEQ ID NO: 10495 - protein, 5 aa, Brucella spp.
SDKLL

SEQ ID NO: 10496 - protein, 4 aa, Brucella spp.
VSED

SEQ ID NO: 10497 - protein, 17 aa, Brucella spp.
AAREGGSGAGVSREGVQ

SEQ ID NO: 10498 - protein, 11 aa, Brucella spp.
TTVATKYGPVK

SEQ ID NO: 10499 - protein, 7 aa, Brucella spp.
SKPSDLL

SEQ ID NO: 10500 - protein, 8 aa, Brucella spp.
TAPDKAGA

SEQ ID NO: 10501 - protein, 15 aa, Brucella spp.
IGGLAKNTDLSRFIL

SEQ ID NO: 10502 - protein, 5 aa, Brucella spp.
NAKPL

SEQ ID NO: 10503 - protein, 31 aa, Brucella spp.
VPPGNRNAEQPPIPGASAKRTHELSTTYEKK

SEQ ID NO: 10504 - protein, 15 aa, Brucella spp.
DASLRSKIRSTAAAY

SEQ ID NO: 10505 - protein, 6 aa, Brucella spp.
YNGESI

SEQ ID NO: 10506 - protein, 14 aa, Brucella spp.
RGKSVGGKAYPNNR

SEQ ID NO: 10507 - protein, 11 aa, Brucella spp.
PKLDADDGNAV

SEQ ID NO: 10508 - protein, 5 aa, Brucella spp.
QSITT

SEQ ID NO: 10509 - protein, 7 aa, Brucella spp.
SKNPGIT

SEQ ID NO: 10510 - protein, 28 aa, Brucella spp.
NTGGTQARAHTPANENARRKAAGQEPML

SEQ ID NO: 10511 - protein, 8 aa, Brucella spp.
KAEPEALP

SEQ ID NO: 10512 - protein, 30 aa, Brucella spp.
EEQEKPGAKIAPPAGEPGRSRKGFSAPGEM

SEQ ID NO: 10513 - protein, 8 aa, Brucella spp.
DRPTHRKI

SEQ ID NO: 10514 - protein, 5 aa, Brucella spp.
TQNEA

SEQ ID NO: 10515 - protein, 8 aa, Brucella spp.
KGRSLGSE

SEQ ID NO: 10516 - protein, 10 aa, Brucella spp.
EDAARHHGGH

SEQ ID NO: 10517 - protein, 13 aa, Brucella spp.
QTRQNTFGGIGRR

SEQ ID NO: 10518 - protein, 10 aa, Brucella spp.
DCPGWDRDDQ

SEQ ID NO: 10519 - protein, 15 aa, Brucella spp.
SADYAENNSYGSGSL

SEQ ID NO: 10520 - protein, 10 aa, Brucella spp.
LDRPDRGEAR

SEQ ID NO: 10521 - protein, 7 aa, Brucella spp.
EPEQGKG

SEQ ID NO: 10522 - protein, 11 aa, Brucella spp.
SDENRPAGLDP

SEQ ID NO: 10523 - protein, 12 aa, Brucella spp.
RQTESGLEEYAD

SEQ ID NO: 10524 - protein, 11 aa, Brucella spp.
RAIEQGALSGH

SEQ ID NO: 10525 - protein, 6 aa, Brucella spp.
LTDGET

SEQ ID NO: 10526 - protein, 8 aa, Brucella spp.
AKTGHPFT

SEQ ID NO: 10527 - protein, 6 aa, Brucella spp.
HPDRAD

SEQ ID NO: 10528 - protein, 10 aa, Brucella spp.
VDDPAAGPVA

SEQ ID NO: 10529 - protein, 6 aa, Brucella spp.
PLTAGR

SEQ ID NO: 10530 - protein, 11 aa, Brucella spp.
DTGTAIVGPAR

SEQ ID NO: 10531 - protein, 18 aa, Brucella spp.
FTGSGDEAGKIAGGIKDE

SEQ ID NO: 10532 - protein, 11 aa, Brucella spp.
TETAAGRVPDR

SEQ ID NO: 10533 - protein, 17 aa, Brucella spp.
STHYSQSYRSHEPRPDR

SEQ ID NO: 10534 - protein, 21 aa, Brucella spp.
TDDYTSRPNEDSPWNRDPKDR

SEQ ID NO: 10535 - protein, 8 aa, Brucella spp.
MGKTTAAG

SEQ ID NO: 10536 - protein, 4 aa, Brucella spp.
PGTV

SEQ ID NO: 10537 - protein, 5 aa, Brucella spp.
GQPEA

SEQ ID NO: 10538 - protein, 15 aa, Brucella spp.
EEDAFRREAEKSGAA

SEQ ID NO: 10539 - protein, 6 aa, Brucella spp.
GAEKRV

SEQ ID NO: 10540 - protein, 4 aa, Brucella spp.
ADIQ

SEQ ID NO: 10541 - protein, 6 aa, Brucella spp.
PGMTQE

SEQ ID NO: 10542 - protein, 9 aa, Brucella spp.
PDAEKRSRA

SEQ ID NO: 10543 - protein, 6 aa, Brucella spp.
SGSFDD

SEQ ID NO: 10544 - protein, 5 aa, Brucella spp.
AAEGG

SEQ ID NO: 10545 - protein, 8 aa, Brucella spp.
HSGAGKTT

SEQ ID NO: 10546 - protein, 7 aa, Brucella spp.
LRPENGR

SEQ ID NO: 10547 - protein, 8 aa, Brucella spp.
INLPPEKR

SEQ ID NO: 10548 - protein, 8 aa, Brucella spp.
HRQATRSF

SEQ ID NO: 10549 - protein, 13 aa, Brucella spp.
RRPSTLSGGERQR

SEQ ID NO: 10550 - protein, 4 aa, Brucella spp.
HARR

SEQ ID NO: 10551 - protein, 8 aa, Brucella spp.
RVTASGAA

SEQ ID NO: 10552 - protein, 7 aa, Brucella spp.
AESEGGG

SEQ ID NO: 10553 - protein, 4 aa, Brucella spp.
AGLK

SEQ ID NO: 10554 - protein, 9 aa, Brucella spp.
IERGEGPNA

SEQ ID NO: 10555 - protein, 5 aa, Brucella spp.
TRRSV

SEQ ID NO: 10556 - protein, 7 aa, Brucella spp.
RGPLGAP

SEQ ID NO: 10557 - protein, 12 aa, Brucella spp.
RGLEEAARTLGA

SEQ ID NO: 10558 - protein, 7 aa, Brucella spp.
IPGETQT

SEQ ID NO: 10559 - protein, 7 aa, Brucella spp.
TPSGDAE

SEQ ID NO: 10560 - protein, 8 aa, Brucella spp.
AASVAQAA

SEQ ID NO: 10561 - protein, 11 aa, Brucella spp.
RQIKARDGTEV

SEQ ID NO: 10562 - protein, 7 aa, Brucella spp.
ASSSALA

SEQ ID NO: 10563 - protein, 7 aa, Brucella spp.
QIEQGAP

SEQ ID NO: 10564 - protein, 11 aa, Brucella spp.
QKDTPKGDARE

SEQ ID NO: 10565 - protein, 16 aa, Brucella spp.
MGDPSNVPAGKYGKAA

SEQ ID NO: 10566 - protein, 5 aa, Brucella spp.
VAAPE

SEQ ID NO: 10567 - protein, 9 aa, Brucella spp.
KKNESDAAR

SEQ ID NO: 10568 - protein, 6 aa, Brucella spp.
DAGQAI

SEQ ID NO: 10569 - protein, 5 aa, Brucella spp.
PIQRR

SEQ ID NO: 10570 - protein, 7 aa, Brucella spp.
RARSSPR

SEQ ID NO: 10571 - protein, 5 aa, Brucella spp.
KSPEM

SEQ ID NO: 10572 - protein, 10 aa, Brucella spp.
GETGSGRQTL

SEQ ID NO: 10573 - protein, 6 aa, Brucella spp.
GGGSRW

SEQ ID NO: 10574 - protein, 7 aa, Brucella spp.
KLAERDG

SEQ ID NO: 10575 - protein, 14 aa, Brucella spp.
SGQYESNGSRVTSN

SEQ ID NO: 10576 - protein, 7 aa, Brucella spp.
MTSSSQP

SEQ ID NO: 10577 - protein, 24 aa, Brucella spp.
PAAPLSVGRAGTAFSGIDADGEVR

SEQ ID NO: 10578 - protein, 4 aa, Brucella spp.
GQIS

SEQ ID NO: 10579 - protein, 23 aa, Brucella spp.
SISGKGKESDLENESCSWGRAAI

SEQ ID NO: 10580 - protein, 16 aa, Brucella spp.
PAADAIAAKKHDLGNL

SEQ ID NO: 10581 - protein, 12 aa, Brucella spp.
YPAPDSPQLASD

SEQ ID NO: 10582 - protein, 4 aa, Brucella spp.
KAMQ

SEQ ID NO: 10583 - protein, 15 aa, Brucella spp.
KLADEAAKPNGGNLA

SEQ ID NO: 10584 - protein, 7 aa, Brucella spp.
DTTDPKR

SEQ ID NO: 10585 - protein, 9 aa, Brucella spp.
QQKLTDAST

SEQ ID NO: 10586 - protein, 7 aa, Brucella spp.
MNENPAI

SEQ ID NO: 10587 - protein, 6 aa, Brucella spp.
KPYQLD

SEQ ID NO: 10588 - protein, 4 aa, Brucella spp.
ITGY

SEQ ID NO: 10589 - protein, 13 aa, Brucella spp.
ADGAVRKQASEAL

SEQ ID NO: 10590 - protein, 9 aa, Brucella spp.
AKDKEISDR

SEQ ID NO: 10591 - protein, 7 aa, Brucella spp.
DSQHLSN

SEQ ID NO: 10592 - protein, 6 aa, Brucella spp.
EDAYPR

SEQ ID NO: 10593 - protein, 9 aa, Brucella spp.
NAPLPETPQ

SEQ ID NO: 10594 - protein, 12 aa, Brucella spp.
PVRPGKAPGAFA

SEQ ID NO: 10595 - protein, 5 aa, Brucella spp.
TVPSA

SEQ ID NO: 10596 - protein, 5 aa, Brucella spp.
GSQGA

SEQ ID NO: 10597 - protein, 9 aa, Brucella spp.
TRDKRERKA

SEQ ID NO: 10598 - protein, 12 aa, Brucella spp.
TERRAGELTSER

SEQ ID NO: 10599 - protein, 5 aa, Brucella spp.
ESLGD

SEQ ID NO: 10600 - protein, 7 aa, Brucella spp.
NSEKGFQ

SEQ ID NO: 10601 - protein, 6 aa, Brucella spp.
GGTKHH

SEQ ID NO: 10602 - protein, 6 aa, Brucella spp.
ASDPGF

SEQ ID NO: 10603 - protein, 6 aa, Brucella spp.
DKAGRD

SEQ ID NO: 10604 - protein, 8 aa, Brucella spp.
ADTPDEFE

SEQ ID NO: 10605 - protein, 7 aa, Brucella spp.
LPEGRKT

SEQ ID NO: 10606 - protein, 7 aa, Brucella spp.
DGPSDEQ

SEQ ID NO: 10607 - protein, 8 aa, Brucella spp.
RDSENATY

SEQ ID NO: 10608 - protein, 4 aa, Brucella spp.
QPVR

SEQ ID NO: 10609 - protein, 15 aa, Brucella spp.
GTMPRGATPEEDERN

SEQ ID NO: 10610 - protein, 8 aa, Brucella spp.
DPKNQAEN

SEQ ID NO: 10611 - protein, 6 aa, Brucella spp.
TGAPKI

SEQ ID NO: 10612 - protein, 6 aa, Brucella spp.
ETGPRD

SEQ ID NO: 10613 - protein, 6 aa, Brucella spp.
TAQAEY

SEQ ID NO: 10614 - protein, 14 aa, Brucella spp.
ATGQKPLPANRIIS

SEQ ID NO: 10615 - protein, 11 aa, Brucella spp.
ETTGPGSGNAP

SEQ ID NO: 10616 - protein, 5 aa, Brucella spp.
PAGIE

SEQ ID NO: 10617 - protein, 9 aa, Brucella spp.
DPNGIASSF

SEQ ID NO: 10618 - protein, 13 aa, Brucella spp.
TRTTDTNEKLAEG

SEQ ID NO: 10619 - protein, 6 aa, Brucella spp.
RGTTSK

SEQ ID NO: 10620 - protein, 17 aa, Brucella spp.
CTSSAGSRFSLTRRNAG

SEQ ID NO: 10621 - protein, 11 aa, Brucella spp.
SQTAQTPLHTS

SEQ ID NO: 10622 - protein, 11 aa, Brucella spp.
GTPDGTSYGPM

SEQ ID NO: 10623 - protein, 8 aa, Brucella spp.
TRPRRSGR

SEQ ID NO: 10624 - protein, 19 aa, Brucella spp.
ENNESPLRTYTRAQGEKLA

SEQ ID NO: 10625 - protein, 8 aa, Brucella spp.
KALSDQPN

SEQ ID NO: 10626 - protein, 7 aa, Brucella spp.
GQPSIES

SEQ ID NO: 10627 - protein, 9 aa, Brucella spp.
YSATTTATV

SEQ ID NO: 10628 - protein, 6 aa, Brucella spp.
PSYEAE

SEQ ID NO: 10629 - protein, 13 aa, Brucella spp.
PKSYSDKGDPYRQ

SEQ ID NO: 10630 - protein, 4 aa, Brucella spp.
GEDE

SEQ ID NO: 10631 - protein, 4 aa, Brucella spp.
RFGP

SEQ ID NO: 10632 - protein, 7 aa, Brucella spp.
YTDETVK

SEQ ID NO: 10633 - protein, 8 aa, Brucella spp.
ELAKNGVK

SEQ ID NO: 10634 - protein, 7 aa, Brucella spp.
EIGNEAA

SEQ ID NO: 10635 - protein, 7 aa, Brucella spp.
ENGGENF

SEQ ID NO: 10636 - protein, 6 aa, Brucella spp.
DSEEGM

SEQ ID NO: 10637 - protein, 6 aa, Brucella spp.
TVPQGY

SEQ ID NO: 10638 - protein, 4 aa, Brucella spp.
TLNP

SEQ ID NO: 10639 - protein, 4 aa, Brucella spp.
QAAY

SEQ ID NO: 10640 - protein, 4 aa, Brucella spp.
RDAI

SEQ ID NO: 10641 - protein, 6 aa, Brucella spp.
INPPAD

SEQ ID NO: 10642 - protein, 10 aa, Brucella spp.
MKAERDKRAQ

SEQ ID NO: 10643 - protein, 8 aa, Brucella spp.
EAEGNRNA

SEQ ID NO: 10644 - protein, 10 aa, Brucella spp.
AEGQKQSQIL

SEQ ID NO: 10645 - protein, 27 aa, Brucella spp.
EGKLEAAKREAEARERLAEAEAKATTM

SEQ ID NO: 10646 - protein, 6 aa, Brucella spp.
VANGNV

SEQ ID NO: 10647 - protein, 7 aa, Brucella spp.
IASAKNQ

SEQ ID NO: 10648 - protein, 26 aa, Brucella spp.
GDGSQPAGPAPQPPARARSVPPTGRD

SEQ ID NO: 10649 - protein, 6 aa, Brucella spp.
TKSIPK

SEQ ID NO: 10650 - protein, 5 aa, Brucella spp.
AREAG

SEQ ID NO: 10651 - protein, 10 aa, Brucella spp.
AERGKTEELN

SEQ ID NO: 10652 - protein, 12 aa, Brucella spp.
LQPQPGTTSFTR

SEQ ID NO: 10653 - protein, 6 aa, Brucella spp.
EQTGGN

SEQ ID NO: 10654 - protein, 7 aa, Brucella spp.
CDPEEAH

SEQ ID NO: 10655 - protein, 8 aa, Brucella spp.
KGGAVGNG

SEQ ID NO: 10656 - protein, 10 aa, Brucella spp.
KPAKGTAPSN

SEQ ID NO: 10657 - protein, 11 aa, Brucella spp.
KQEKGAGNEIQ

SEQ ID NO: 10658 - protein, 7 aa, Brucella spp.
RPSVEGS

SEQ ID NO: 10659 - protein, 9 aa, Brucella spp.
TTAQSLEAK

SEQ ID NO: 10660 - protein, 8 aa, Brucella spp.
PKYGSTYA

SEQ ID NO: 10661 - protein, 8 aa, Brucella spp.
PGQEQGAL

SEQ ID NO: 10662 - protein, 13 aa, Brucella spp.
GGFKTKPGSPSYV

SEQ ID NO: 10663 - protein, 7 aa, Brucella spp.
SADVTTK

SEQ ID NO: 10664 - protein, 22 aa, Brucella spp.
KTPDAAAAVAAPVKKRQPADRN

SEQ ID NO: 10665 - protein, 17 aa, Brucella spp.
PSSQSMPATGAANAPVR

SEQ ID NO: 10666 - protein, 23 aa, Brucella spp.
KTEQPATTDAPPGKDNTDGVVVF

SEQ ID NO: 10667 - protein, 6 aa, Brucella spp.
REEEPH

SEQ ID NO: 10668 - protein, 5 aa, Brucella spp.
VSLAG

SEQ ID NO: 10669 - protein, 6 aa, Brucella spp.
NGTQAS

SEQ ID NO: 10670 - protein, 11 aa, Brucella spp.
AAAEAENPMRN

SEQ ID NO: 10671 - protein, 8 aa, Brucella spp.
QVDPNSSP

SEQ ID NO: 10672 - protein, 12 aa, Brucella spp.
SASSSSNSGIYS

SEQ ID NO: 10673 - protein, 13 aa, Brucella spp.
APKAFSKLSNRKV

SEQ ID NO: 10674 - protein, 18 aa, Brucella spp.
KHPERHEKSTFKMPGGRA

SEQ ID NO: 10675 - protein, 6 aa, Brucella spp.
QEPDTL

SEQ ID NO: 10676 - protein, 8 aa, Brucella spp.
KYQPASDR

SEQ ID NO: 10677 - protein, 8 aa, Brucella spp.
DGEVQKQA

SEQ ID NO: 10678 - protein, 4 aa, Brucella spp.
PTGC

SEQ ID NO: 10679 - protein, 8 aa, Brucella spp.
EQALGDKA

SEQ ID NO: 10680 - protein, 9 aa, Brucella spp.
QPAASKTGK

SEQ ID NO: 10681 - protein, 9 aa, Brucella spp.
SGPAGLAAA

SEQ ID NO: 10682 - protein, 7 aa, Brucella spp.
RESRPGG

SEQ ID NO: 10683 - protein, 4 aa, Brucella spp.
MEGE

SEQ ID NO: 10684 - protein, 15 aa, Brucella spp.
GSETPRPAGIPGADL

SEQ ID NO: 10685 - protein, 7 aa, Brucella spp.
RRVGREN

SEQ ID NO: 10686 - protein, 8 aa, Brucella spp.
GGDTASDC

SEQ ID NO: 10687 - protein, 10 aa, Brucella spp.
RPQPPEKEDK

SEQ ID NO: 10688 - protein, 14 aa, Brucella spp.
MRTSSSQAEGASRE

SEQ ID NO: 10689 - protein, 7 aa, Brucella spp.
EKRRPIA

SEQ ID NO: 10690 - protein, 20 aa, Brucella spp.
ATDRRGSKSVKANDRDYRTN

SEQ ID NO: 10691 - protein, 5 aa, Brucella spp.
DIRRG

SEQ ID NO: 10692 - protein, 6 aa, Brucella spp.
GRQAAH

SEQ ID NO: 10693 - protein, 40 aa, Brucella spp.
VQNEAVKAATTASTRTTRKTKAAGVPPAQGLYDPRNEHDA

SEQ ID NO: 10694 - protein, 5 aa, Brucella spp.
RGAVG

SEQ ID NO: 10695 - protein, 7 aa, Brucella spp.
ADPLMGD

SEQ ID NO: 10696 - protein, 6 aa, Brucella spp.
LPQPGH

SEQ ID NO: 10697 - protein, 13 aa, Brucella spp.
VDNSSLSKAPHIA

SEQ ID NO: 10698 - protein, 6 aa, Brucella spp.
LETDDD

SEQ ID NO: 10699 - protein, 9 aa, Brucella spp.
QENDGDDKG

SEQ ID NO: 10700 - protein, 5 aa, Brucella spp.
DPRFE

SEQ ID NO: 10701 - protein, 8 aa, Brucella spp.
ARQASVDS

SEQ ID NO: 10702 - protein, 9 aa, Brucella spp.
YEGQSDTAC

SEQ ID NO: 10703 - protein, 5 aa, Brucella spp.
LMSDE

SEQ ID NO: 10704 - protein, 4 aa, Brucella spp.
WDGP

SEQ ID NO: 10705 - protein, 5 aa, Brucella spp.
NGLRP

SEQ ID NO: 10706 - protein, 11 aa, Brucella spp.
EIKSQIAQKHP

SEQ ID NO: 10707 - protein, 6 aa, Brucella spp.
PVEPRA

SEQ ID NO: 10708 - protein, 7 aa, Brucella spp.
FGYTQED

SEQ ID NO: 10709 - protein, 23 aa, Brucella spp.
ATTGQEAIGSMGTDTPISAMSDK

SEQ ID NO: 10710 - protein, 8 aa, Brucella spp.
VTNPPIDP

SEQ ID NO: 10711 - protein, 6 aa, Brucella spp.
SRRKRL

SEQ ID NO: 10712 - protein, 9 aa, Brucella spp.
GHTEDRFDT

SEQ ID NO: 10713 - protein, 10 aa, Brucella spp.
YNTGEGATGM

SEQ ID NO: 10714 - protein, 4 aa, Brucella spp.
AAVH

SEQ ID NO: 10715 - protein, 7 aa, Brucella spp.
RQVGPDR

SEQ ID NO: 10716 - protein, 7 aa, Brucella spp.
ESGEPRE

SEQ ID NO: 10717 - protein, 6 aa, Brucella spp.
EFPPEV

SEQ ID NO: 10718 - protein, 5 aa, Brucella spp.
EETVR

SEQ ID NO: 10719 - protein, 7 aa, Brucella spp.
TDAFGND

SEQ ID NO: 10720 - protein, 10 aa, Brucella spp.
VRTSNPDTFT

SEQ ID NO: 10721 - protein, 9 aa, Brucella spp.
AKSSQAKTI

SEQ ID NO: 10722 - protein, 5 aa, Brucella spp.
RGLKP

SEQ ID NO: 10723 - protein, 6 aa, Brucella spp.
EVEPAT

SEQ ID NO: 10724 - protein, 6 aa, Brucella spp.
REAHTT

SEQ ID NO: 10725 - protein, 16 aa, Brucella spp.
IGGKSNTGEGGEEPDR

SEQ ID NO: 10726 - protein, 12 aa, Brucella spp.
PDGTANPERSAI

SEQ ID NO: 10727 - protein, 5 aa, Brucella spp.
ASGRF

SEQ ID NO: 10728 - protein, 14 aa, Brucella spp.
QGAKPGEGGQLPGH

SEQ ID NO: 10729 - protein, 11 aa, Brucella spp.
IAKTRHSTPGV

SEQ ID NO: 10730 - protein, 5 aa, Brucella spp.
SPPPH

SEQ ID NO: 10731 - protein, 6 aa, Brucella spp.
VNPAAD

SEQ ID NO: 10732 - protein, 8 aa, Brucella spp.
VAKARADH

SEQ ID NO: 10733 - protein, 13 aa, Brucella spp.
GYDGGTGASPLTS

SEQ ID NO: 10734 - protein, 5 aa, Brucella spp.
AGSPW

SEQ ID NO: 10735 - protein, 7 aa, Brucella spp.
GGLRTGR

SEQ ID NO: 10736 - protein, 4 aa, Brucella spp.
TQDP

SEQ ID NO: 10737 - protein, 5 aa, Brucella spp.
KGTPE

SEQ ID NO: 10738 - protein, 5 aa, Brucella spp.
PEAEK

SEQ ID NO: 10739 - protein, 7 aa, Brucella spp.
ALEERQP

SEQ ID NO: 10740 - protein, 7 aa, Brucella spp.
VDRSAGA

SEQ ID NO: 10741 - protein, 6 aa, Brucella spp.
GLPEDT

SEQ ID NO: 10742 - protein, 7 aa, Brucella spp.
RGTAGQS

SEQ ID NO: 10743 - protein, 12 aa, Brucella spp.
GNDYIGKGLSGG

SEQ ID NO: 10744 - protein, 8 aa, Brucella spp.
RPPEDTRI

SEQ ID NO: 10745 - protein, 5 aa, Brucella spp.
TGRNF

SEQ ID NO: 10746 - protein, 4 aa, Brucella spp.
AGMS

SEQ ID NO: 10747 - protein, 5 aa, Brucella spp.
EGDFA

SEQ ID NO: 10748 - protein, 7 aa, Brucella spp.
PVPEEDD

SEQ ID NO: 10749 - protein, 4 aa, Brucella spp.
HHDE

SEQ ID NO: 10750 - protein, 8 aa, Brucella spp.
TGSTRAKD

SEQ ID NO: 10751 - protein, 5 aa, Brucella spp.
HPKIA

SEQ ID NO: 10752 - protein, 8 aa, Brucella spp.
YGASEIDK

SEQ ID NO: 10753 - protein, 7 aa, Brucella spp.
GTAANSL

SEQ ID NO: 10754 - protein, 7 aa, Brucella spp.
VNRPGGV

SEQ ID NO: 10755 - protein, 7 aa, Brucella spp.
CGAPEYF

SEQ ID NO: 10756 - protein, 5 aa, Brucella spp.
QATEV

SEQ ID NO: 10757 - protein, 5 aa, Brucella spp.
GGTKN

SEQ ID NO: 10758 - protein, 4 aa, Brucella spp.
PEAN

SEQ ID NO: 10759 - protein, 11 aa, Brucella spp.
PPHSEVGRIGE

SEQ ID NO: 10760 - protein, 15 aa, Brucella spp.
ANTEEEVDRFGDMIA

SEQ ID NO: 10761 - protein, 22 aa, Brucella spp.
ASPEGNQSYPPYNIERTGENAY

SEQ ID NO: 10762 - protein, 14 aa, Brucella spp.
TVKGQKADETASDV

SEQ ID NO: 10763 - protein, 5 aa, Brucella spp.
GASLK

SEQ ID NO: 10764 - protein, 6 aa, Brucella spp.
IPEQMK

SEQ ID NO: 10765 - protein, 18 aa, Brucella spp.
VTKAGSGTAQPIEAKTAH

SEQ ID NO: 10766 - protein, 16 aa, Brucella spp.
TAATGIATPTLAADNG

SEQ ID NO: 10767 - protein, 25 aa, Brucella spp.
DDGYRVPRQGFDGPGRHDRRPNWGD

SEQ ID NO: 10768 - protein, 6 aa, Brucella spp.
LERRGY

SEQ ID NO: 10769 - protein, 6 aa, Brucella spp.
TRPSGR

SEQ ID NO: 10770 - protein, 5 aa, Brucella spp.
PIPSR

SEQ ID NO: 10771 - protein, 5 aa, Brucella spp.
PDGKA

SEQ ID NO: 10772 - protein, 6 aa, Brucella spp.
ESRPCR

SEQ ID NO: 10773 - protein, 4 aa, Brucella spp.
AGRG

SEQ ID NO: 10774 - protein, 7 aa, Brucella spp.
RGQGGSH

SEQ ID NO: 10775 - protein, 10 aa, Brucella spp.
GQKISDDNVR

SEQ ID NO: 10776 - protein, 8 aa, Brucella spp.
AGGRTLSA

SEQ ID NO: 10777 - protein, 8 aa, Brucella spp.
ADNPLTSD

SEQ ID NO: 10778 - protein, 4 aa, Brucella spp.
LGGP

SEQ ID NO: 10779 - protein, 20 aa, Brucella spp.
PGSSPVESMPQSLEPDLSQI

SEQ ID NO: 10780 - protein, 10 aa, Brucella spp.
NGASAYERLQ

SEQ ID NO: 10781 - protein, 6 aa, Brucella spp.
ATEIDP

SEQ ID NO: 10782 - protein, 12 aa, Brucella spp.
LNPDSDAPRDAK

SEQ ID NO: 10783 - protein, 5 aa, Brucella spp.
AVTGL

SEQ ID NO: 10784 - protein, 6 aa, Brucella spp.
VRESRE

SEQ ID NO: 10785 - protein, 5 aa, Brucella spp.
ASAGR

SEQ ID NO: 10786 - protein, 10 aa, Brucella spp.
QSPPNNERAA

SEQ ID NO: 10787 - protein, 9 aa, Brucella spp.
LSRGEKPHV

SEQ ID NO: 10788 - protein, 9 aa, Brucella spp.
QEKDPPVRS

SEQ ID NO: 10789 - protein, 6 aa, Brucella spp.
ALTEGA

SEQ ID NO: 10790 - protein, 13 aa, Brucella spp.
RDSGGGIAPADQE

SEQ ID NO: 10791 - protein, 6 aa, Brucella spp.
KKGGFG

SEQ ID NO: 10792 - protein, 17 aa, Brucella spp.
ESSGGTIALGSTTPHGT

SEQ ID NO: 10793 - protein, 9 aa, Brucella spp.
SGDSSPTRV

SEQ ID NO: 10794 - protein, 4 aa, Brucella spp.
AEAQ

SEQ ID NO: 10795 - protein, 10 aa, Brucella spp.
SSNIEGTNRV

SEQ ID NO: 10796 - protein, 8 aa, Brucella spp.
VRADQRQD

SEQ ID NO: 10797 - protein, 9 aa, Brucella spp.
NFKKDERRL

SEQ ID NO: 10798 - protein, 6 aa, Brucella spp.
REASNE

SEQ ID NO: 10799 - protein, 13 aa, Brucella spp.
VGSRRDGLTEGDA

SEQ ID NO: 10800 - protein, 11 aa, Brucella spp.
RDGPNEVARER

SEQ ID NO: 10801 - protein, 8 aa, Brucella spp.
TGEEADPT

SEQ ID NO: 10802 - protein, 8 aa, Brucella spp.
RSGRAAEA

SEQ ID NO: 10803 - protein, 11 aa, Brucella spp.
SAGTSSAPREI

SEQ ID NO: 10804 - protein, 17 aa, Brucella spp.
GAISEKSAMATASQDAD

SEQ ID NO: 10805 - protein, 5 aa, Brucella spp.
VSGTA

SEQ ID NO: 10806 - protein, 5 aa, Brucella spp.
GQRTY

SEQ ID NO: 10807 - protein, 12 aa, Brucella spp.
VGSRAQTSFDRG

SEQ ID NO: 10808 - protein, 4 aa, Brucella spp.
LAKG

SEQ ID NO: 10809 - protein, 7 aa, Brucella spp.
KTGTLTQ

SEQ ID NO: 10810 - protein, 7 aa, Brucella spp.
SGKADDK

SEQ ID NO: 10811 - protein, 5 aa, Brucella spp.
HQSGV

SEQ ID NO: 10812 - protein, 6 aa, Brucella spp.
RDGETV

SEQ ID NO: 10813 - protein, 12 aa, Brucella spp.
EIPGAETSAQYR

SEQ ID NO: 10814 - protein, 10 aa, Brucella spp.
PPKETAGPAI

SEQ ID NO: 10815 - protein, 4 aa, Brucella spp.
KLDD

SEQ ID NO: 10816 - protein, 4 aa, Brucella spp.
PLQK

SEQ ID NO: 10817 - protein, 4 aa, Brucella spp.
ANGH

SEQ ID NO: 10818 - protein, 9 aa, Brucella spp.
INDAPALRD

SEQ ID NO: 10819 - protein, 12 aa, Brucella spp.
SVDSGADIAKES

SEQ ID NO: 10820 - protein, 5 aa, Brucella spp.
TGRET

SEQ ID NO: 10821 - protein, 7 aa, Brucella spp.
PRKWDAR

SEQ ID NO: 10822 - protein, 6 aa, Brucella spp.
NSPQMQ

SEQ ID NO: 10823 - protein, 6 aa, Brucella spp.
ESGFEY

SEQ ID NO: 10824 - protein, 10 aa, Brucella spp.
PGDNGPQGRL

SEQ ID NO: 10825 - protein, 4 aa, Brucella spp.
FDTT

SEQ ID NO: 10826 - protein, 12 aa, Brucella spp.
GTMETPRRQAFP

SEQ ID NO: 10827 - protein, 5 aa, Brucella spp.
ISPSF

SEQ ID NO: 10828 - protein, 6 aa, Brucella spp.
KSYNPL

SEQ ID NO: 10829 - protein, 7 aa, Brucella spp.
MSPGADS

SEQ ID NO: 10830 - protein, 6 aa, Brucella spp.
GRQTAR

SEQ ID NO: 10831 - protein, 7 aa, Brucella spp.
GSDDNAV

SEQ ID NO: 10832 - protein, 4 aa, Brucella spp.
NDLS

SEQ ID NO: 10833 - protein, 7 aa, Brucella spp.
LEGPGAL

SEQ ID NO: 10834 - protein, 28 aa, Brucella spp.
AREYGESEIRQGQKPNGETNPSTEEYDR

SEQ ID NO: 10835 - protein, 6 aa, Brucella spp.
KPKAGA

SEQ ID NO: 10836 - protein, 7 aa, Brucella spp.
DTPQGPD

SEQ ID NO: 10837 - protein, 4 aa, Brucella spp.
QHPQ

SEQ ID NO: 10838 - protein, 10 aa, Brucella spp.
SALPVANGAP

SEQ ID NO: 10839 - protein, 20 aa, Brucella spp.
IQGGRGGYWEDQGYDWYGGI

SEQ ID NO: 10840 - protein, 6 aa, Brucella spp.
PDQPVS

SEQ ID NO: 10841 - protein, 4 aa, Brucella spp.
TVRE

SEQ ID NO: 10842 - protein, 9 aa, Brucella spp.
DEKEQGRPV

SEQ ID NO: 10843 - protein, 15 aa, Brucella spp.
FPDPRAEAGRRMETD

SEQ ID NO: 10844 - protein, 8 aa, Brucella spp.
QGESGHPF

SEQ ID NO: 10845 - protein, 10 aa, Brucella spp.
DAYRASPRWE

SEQ ID NO: 10846 - protein, 9 aa, Brucella spp.
GAEDYGEAG

SEQ ID NO: 10847 - protein, 4 aa, Brucella spp.
TDIG

SEQ ID NO: 10848 - protein, 6 aa, Brucella spp.
QGEDEG

SEQ ID NO: 10849 - protein, 5 aa, Brucella spp.
DRGLV

SEQ ID NO: 10850 - protein, 8 aa, Brucella spp.
ANGPGDGF

SEQ ID NO: 10851 - protein, 5 aa, Brucella spp.
VDGAG

SEQ ID NO: 10852 - protein, 7 aa, Brucella spp.
AAMRPDA

SEQ ID NO: 10853 - protein, 4 aa, Brucella spp.
SNLA

SEQ ID NO: 10854 - protein, 9 aa, Brucella spp.
AGIGKGDTA

SEQ ID NO: 10855 - protein, 7 aa, Brucella spp.
EADHASS

SEQ ID NO: 10856 - protein, 15 aa, Brucella spp.
TPADKAVPFSPTGAG

SEQ ID NO: 10857 - protein, 9 aa, Brucella spp.
GGSTGTPKL

SEQ ID NO: 10858 - protein, 8 aa, Brucella spp.
YPMSSPGA

SEQ ID NO: 10859 - protein, 5 aa, Brucella spp.
PNPEP

SEQ ID NO: 10860 - protein, 5 aa, Brucella spp.
LDDPD

SEQ ID NO: 10861 - protein, 10 aa, Brucella spp.
QGRPISPDDE

SEQ ID NO: 10862 - protein, 13 aa, Brucella spp.
EDGEPVAEGQPGM

SEQ ID NO: 10863 - protein, 4 aa, Brucella spp.
TRGP

SEQ ID NO: 10864 - protein, 6 aa, Brucella spp.
SPEHNA

SEQ ID NO: 10865 - protein, 7 aa, Brucella spp.
VQRTPEG

SEQ ID NO: 10866 - protein, 14 aa, Brucella spp.
DQINRGGEKVAAEE

SEQ ID NO: 10867 - protein, 7 aa, Brucella spp.
NPDLKPP

SEQ ID NO: 10868 - protein, 6 aa, Brucella spp.
AQGIGR

SEQ ID NO: 10869 - protein, 9 aa, Brucella spp.
RQAGEADAP

SEQ ID NO: 10870 - protein, 10 aa, Brucella spp.
SDGLKAEGKP

SEQ ID NO: 10871 - protein, 10 aa, Brucella spp.
GNSDRLSAED

SEQ ID NO: 10872 - protein, 4 aa, Brucella spp.
AAHV

SEQ ID NO: 10873 - protein, 9 aa, Brucella spp.
VSPGSTRTA

SEQ ID NO: 10874 - protein, 8 aa, Brucella spp.
NDPSGEAQ

SEQ ID NO: 10875 - protein, 5 aa, Brucella spp.
QAGHV

SEQ ID NO: 10876 - protein, 15 aa, Brucella spp.
LPRPEQTVNASGYGI

SEQ ID NO: 10877 - protein, 11 aa, Brucella spp.
GLGGKGANQAV

SEQ ID NO: 10878 - protein, 6 aa, Brucella spp.
ETGQNT

SEQ ID NO: 10879 - protein, 7 aa, Brucella spp.
NARWSSA

SEQ ID NO: 10880 - protein, 6 aa, Brucella spp.
DAYGAD

SEQ ID NO: 10881 - protein, 6 aa, Brucella spp.
VRAAGG

SEQ ID NO: 10882 - protein, 9 aa, Brucella spp.
PAPVGDASQ

SEQ ID NO: 10883 - protein, 10 aa, Brucella spp.
SPNETEAAEI

SEQ ID NO: 10884 - protein, 16 aa, Brucella spp.
TGIEPTDLASAEAAGR

SEQ ID NO: 10885 - protein, 8 aa, Brucella spp.
AAGDSFNG

SEQ ID NO: 10886 - protein, 5 aa, Brucella spp.
GSAAG

SEQ ID NO: 10887 - protein, 19 aa, Brucella spp.
GAGAAAPTAREVEELIGRA

SEQ ID NO: 10888 - protein, 18 aa, Brucella spp.
DEPAAEQASAPAENVSRR

SEQ ID NO: 10889 - protein, 10 aa, Brucella spp.
GAAKSLSASI

SEQ ID NO: 10890 - protein, 12 aa, Brucella spp.
LAKQASQRLDGE

SEQ ID NO: 10891 - protein, 4 aa, Brucella spp.
PADL

SEQ ID NO: 10892 - protein, 10 aa, Brucella spp.
LPETDDQEYK

SEQ ID NO: 10893 - protein, 8 aa, Brucella spp.
RERGQDSP

SEQ ID NO: 10894 - protein, 6 aa, Brucella spp.
HPQTSG

SEQ ID NO: 10895 - protein, 9 aa, Brucella spp.
QGQENSARA

SEQ ID NO: 10896 - protein, 9 aa, Brucella spp.
STPGSHGFR

SEQ ID NO: 10897 - protein, 10 aa, Brucella spp.
RGHSGRPDCR

SEQ ID NO: 10898 - protein, 7 aa, Brucella spp.
PAKGIGR

SEQ ID NO: 10899 - protein, 11 aa, Brucella spp.
MPGKKAAAAEL

SEQ ID NO: 10900 - protein, 11 aa, Brucella spp.
SFKSASSPDRF

SEQ ID NO: 10901 - protein, 18 aa, Brucella spp.
GGRQKRPVTKSASRPGSI

SEQ ID NO: 10902 - protein, 4 aa, Brucella spp.
APDR

SEQ ID NO: 10903 - protein, 9 aa, Brucella spp.
QTGKTATLA

SEQ ID NO: 10904 - protein, 5 aa, Brucella spp.
GREIS

SEQ ID NO: 10905 - protein, 9 aa, Brucella spp.
NFPPDARKN

SEQ ID NO: 10906 - protein, 5 aa, Brucella spp.
SPSNL

SEQ ID NO: 10907 - protein, 9 aa, Brucella spp.
EGKGVEPTI

SEQ ID NO: 10908 - protein, 6 aa, Brucella spp.
GGRRAY

SEQ ID NO: 10909 - protein, 7 aa, Brucella spp.
QNGRAEV

SEQ ID NO: 10910 - protein, 7 aa, Brucella spp.
HRRGNEK

SEQ ID NO: 10911 - protein, 11 aa, Brucella spp.
KGGSGKTTTAA

SEQ ID NO: 10912 - protein, 6 aa, Brucella spp.
DPQASL

SEQ ID NO: 10913 - protein, 8 aa, Brucella spp.
YDSERKSI

SEQ ID NO: 10914 - protein, 9 aa, Brucella spp.
MQNGGEGKT

SEQ ID NO: 10915 - protein, 5 aa, Brucella spp.
EVDDS

SEQ ID NO: 10916 - protein, 5 aa, Brucella spp.
RQAGG

SEQ ID NO: 10917 - protein, 7 aa, Brucella spp.
EPTDVPQ

SEQ ID NO: 10918 - protein, 11 aa, Brucella spp.
TAISDAGLTKQ

SEQ ID NO: 10919 - protein, 11 aa, Brucella spp.
RSSMNRGTYDR

SEQ ID NO: 10920 - protein, 17 aa, Brucella spp.
ATSQAQEVKRDTKKQGE

SEQ ID NO: 10921 - protein, 10 aa, Brucella spp.
KDNIEATGGT

SEQ ID NO: 10922 - protein, 6 aa, Brucella spp.
KLQPAN

SEQ ID NO: 10923 - protein, 13 aa, Brucella spp.
SIAVSGGGGPSKR

SEQ ID NO: 10924 - protein, 8 aa, Brucella spp.
DGVPQTAT

SEQ ID NO: 10925 - protein, 15 aa, Brucella spp.
EAGAAAADSGFGAAA

SEQ ID NO: 10926 - protein, 5 aa, Brucella spp.
PGKTF

SEQ ID NO: 10927 - protein, 19 aa, Brucella spp.
SYGTNGRGFSGSTAAYGLK

SEQ ID NO: 10928 - protein, 23 aa, Brucella spp.
TSGHNYKNGDGTEILGTEPAARN

SEQ ID NO: 10929 - protein, 5 aa, Brucella spp.
YEFDG

SEQ ID NO: 10930 - protein, 10 aa, Brucella spp.
YERSRDKADR

SEQ ID NO: 10931 - protein, 8 aa, Brucella spp.
LPGDTEYP

SEQ ID NO: 10932 - protein, 9 aa, Brucella spp.
YTRTDATDM

SEQ ID NO: 10933 - protein, 7 aa, Brucella spp.
YQNRTNG

SEQ ID NO: 10934 - protein, 14 aa, Brucella spp.
HDYNTDNYGHNDRR

SEQ ID NO: 10935 - protein, 8 aa, Brucella spp.
LSTGARYD

SEQ ID NO: 10936 - protein, 11 aa, Brucella spp.
FSDSGASVNGT

SEQ ID NO: 10937 - protein, 14 aa, Brucella spp.
TDPTFSPGRARNYK

SEQ ID NO: 10938 - protein, 6 aa, Brucella spp.
NFGGAD

SEQ ID NO: 10939 - protein, 19 aa, Brucella spp.
LPNYDSQKLGNDPEEYRSR

SEQ ID NO: 10940 - protein, 13 aa, Brucella spp.
KVTAGDDPVLPNS

SEQ ID NO: 10941 - protein, 10 aa, Brucella spp.
ISDEAATAAN

SEQ ID NO: 10942 - protein, 5 aa, Brucella spp.
WNPPA

SEQ ID NO: 10943 - protein, 11 aa, Brucella spp.
SFAPSQNRGGI

SEQ ID NO: 10944 - protein, 5 aa, Brucella spp.
QSGLG

SEQ ID NO: 10945 - protein, 10 aa, Brucella spp.
PSGCGKSTAM

SEQ ID NO: 10946 - protein, 7 aa, Brucella spp.
LQPSGGG

SEQ ID NO: 10947 - protein, 11 aa, Brucella spp.
KPVTGPGPERG

SEQ ID NO: 10948 - protein, 8 aa, Brucella spp.
PKALSGGM

SEQ ID NO: 10949 - protein, 5 aa, Brucella spp.
RPGRL

SEQ ID NO: 10950 - protein, 4 aa, Brucella spp.
YPRT

SEQ ID NO: 10951 - protein, 13 aa, Brucella spp.
QQPQTDQQSSHGQ

SEQ ID NO: 10952 - protein, 5 aa, Brucella spp.
ASEKG

SEQ ID NO: 10953 - protein, 4 aa, Brucella spp.
LDAD

SEQ ID NO: 10954 - protein, 6 aa, Brucella spp.
ASGKAK

SEQ ID NO: 10955 - protein, 13 aa, Brucella spp.
GKKIGVPEGTSGD

SEQ ID NO: 10956 - protein, 5 aa, Brucella spp.
SKQID

SEQ ID NO: 10957 - protein, 7 aa, Brucella spp.
AENPEAV

SEQ ID NO: 10958 - protein, 13 aa, Brucella spp.
EDFRTANPEQSVD

SEQ ID NO: 10959 - protein, 16 aa, Brucella spp.
ANLETEAKNGKSLTSE

SEQ ID NO: 10960 - protein, 6 aa, Brucella spp.
TRDGSV

SEQ ID NO: 10961 - protein, 18 aa, Brucella spp.
KSPLDPKDYYLADYFTAK

SEQ ID NO: 10962 - protein, 8 aa, Brucella spp.
RNTSPTID

SEQ ID NO: 10963 - protein, 4 aa, Brucella spp.
CHPS

SEQ ID NO: 10964 - protein, 7 aa, Brucella spp.
GHGGTAC

SEQ ID NO: 10965 - protein, 11 aa, Brucella spp.
EPFREGASRAW

SEQ ID NO: 10966 - protein, 4 aa, Brucella spp.
SFGE

SEQ ID NO: 10967 - protein, 8 aa, Brucella spp.
KGGMENAD

SEQ ID NO: 10968 - protein, 4 aa, Brucella spp.
TPYR

SEQ ID NO: 10969 - protein, 7 aa, Brucella spp.
DPFAGEP

SEQ ID NO: 10970 - protein, 21 aa, Brucella spp.
GYGPHSPQEPTGFSADNPHAH

SEQ ID NO: 10971 - protein, 5 aa, Brucella spp.
HGENL

SEQ ID NO: 10972 - protein, 6 aa, Brucella spp.
HQTADE

SEQ ID NO: 10973 - protein, 7 aa, Brucella spp.
GQAPGVN

SEQ ID NO: 10974 - protein, 7 aa, Brucella spp.
GGKVPSV

SEQ ID NO: 10975 - protein, 14 aa, Brucella spp.
FAPAMRRNKNGGRD

SEQ ID NO: 10976 - protein, 15 aa, Brucella spp.
SDPHEQTDLSQSRPD

SEQ ID NO: 10977 - protein, 7 aa, Brucella spp.
CSDQDVD

SEQ ID NO: 10978 - protein, 6 aa, Brucella spp.
GGPYHT

SEQ ID NO: 10979 - protein, 9 aa, Brucella spp.
ATGRGDHAD

SEQ ID NO: 10980 - protein, 14 aa, Brucella spp.
ARHPQREKEKATLR

SEQ ID NO: 10981 - protein, 4 aa, Brucella spp.
ARPW

SEQ ID NO: 10982 - protein, 14 aa, Brucella spp.
STAEIEAYRTGETE

SEQ ID NO: 10983 - protein, 7 aa, Brucella spp.
LPAGASV

SEQ ID NO: 10984 - protein, 7 aa, Brucella spp.
QAEAAVP

SEQ ID NO: 10985 - protein, 7 aa, Brucella spp.
NSEASLA

SEQ ID NO: 10986 - protein, 4 aa, Brucella spp.
AASL

SEQ ID NO: 10987 - protein, 20 aa, Brucella spp.
NDQPDPPAGSFGRDPATGRL

SEQ ID NO: 10988 - protein, 8 aa, Brucella spp.
GLDNKGKL

SEQ ID NO: 10989 - protein, 8 aa, Brucella spp.
VPGARTSA

SEQ ID NO: 10990 - protein, 8 aa, Brucella spp.
VHPRGYRG

SEQ ID NO: 10991 - protein, 6 aa, Brucella spp.
KSEKLG

SEQ ID NO: 10992 - protein, 5 aa, Brucella spp.
VRPQD

SEQ ID NO: 10993 - protein, 9 aa, Brucella spp.
KEAMGDERA

SEQ ID NO: 10994 - protein, 4 aa, Brucella spp.
AGGS

SEQ ID NO: 10995 - protein, 10 aa, Brucella spp.
TRQNPSGAFP

SEQ ID NO: 10996 - protein, 12 aa, Brucella spp.
AETGSIEPGKSA

SEQ ID NO: 10997 - protein, 4 aa, Brucella spp.
DRIA

SEQ ID NO: 10998 - protein, 7 aa, Brucella spp.
GGDSGLT

SEQ ID NO: 10999 - protein, 5 aa, Brucella spp.
SGTPA

SEQ ID NO: 11000 - protein, 14 aa, Brucella spp.
YSEEARDPGRTVPR

SEQ ID NO: 11001 - protein, 6 aa, Brucella spp.
AGAGKL

SEQ ID NO: 11002 - protein, 4 aa, Brucella spp.
LQDP

SEQ ID NO: 11003 - protein, 8 aa, Brucella spp.
HPQYQSPH

SEQ ID NO: 11004 - protein, 9 aa, Brucella spp.
PGLESNPFT

SEQ ID NO: 11005 - protein, 4 aa, Brucella spp.
AGAN

SEQ ID NO: 11006 - protein, 16 aa, Brucella spp.
GTNAAGFARLGAGQAV

SEQ ID NO: 11007 - protein, 6 aa, Brucella spp.
LPAGSL

SEQ ID NO: 11008 - protein, 8 aa, Brucella spp.
GPFDPSTD

SEQ ID NO: 11009 - protein, 5 aa, Brucella spp.
REITE

SEQ ID NO: 11010 - protein, 6 aa, Brucella spp.
TRETGA

SEQ ID NO: 11011 - protein, 7 aa, Brucella spp.
ARGAEPE

SEQ ID NO: 11012 - protein, 7 aa, Brucella spp.
KPDPRAY

SEQ ID NO: 11013 - protein, 7 aa, Brucella spp.
KKNIEGA

SEQ ID NO: 11014 - protein, 15 aa, Brucella spp.
RPAESYAQALKMLGI

SEQ ID NO: 11015 - protein, 13 aa, Brucella spp.
GRSDEEKRKTGEA

SEQ ID NO: 11016 - protein, 14 aa, Brucella spp.
IGGEDVAAADGATF

SEQ ID NO: 11017 - protein, 15 aa, Brucella spp.
AADIDRAARAAKAAF

SEQ ID NO: 11018 - protein, 6 aa, Brucella spp.
SGDARK

SEQ ID NO: 11019 - protein, 4 aa, Brucella spp.
LRGA

SEQ ID NO: 11020 - protein, 17 aa, Brucella spp.
RAPEARDGKTLRGPGQV

SEQ ID NO: 11021 - protein, 5 aa, Brucella spp.
AEFSP

SEQ ID NO: 11022 - protein, 6 aa, Brucella spp.
EAGLPK

SEQ ID NO: 11023 - protein, 13 aa, Brucella spp.
FGEDAGKALTEHP

SEQ ID NO: 11024 - protein, 7 aa, Brucella spp.
GESRTGS

SEQ ID NO: 11025 - protein, 5 aa, Brucella spp.
GADTL

SEQ ID NO: 11026 - protein, 8 aa, Brucella spp.
GERCTSSS

SEQ ID NO: 11027 - protein, 5 aa, Brucella spp.
KAKRI

SEQ ID NO: 11028 - protein, 6 aa, Brucella spp.
PLDPET

SEQ ID NO: 11029 - protein, 21 aa, Brucella spp.
RSEGATVAAGGAKFAGPGGGC

SEQ ID NO: 11030 - protein, 4 aa, Brucella spp.
DEAE

SEQ ID NO: 11031 - protein, 6 aa, Brucella spp.
TPFGGV

SEQ ID NO: 11032 - protein, 11 aa, Brucella spp.
KNSGIGRDGGD

SEQ ID NO: 11033 - protein, 7 aa, Brucella spp.
VTDESAD

SEQ ID NO: 11034 - protein, 8 aa, Brucella spp.
TDKAEARD

SEQ ID NO: 11035 - protein, 5 aa, Brucella spp.
EDDFD

SEQ ID NO: 11036 - protein, 14 aa, Brucella spp.
PYQSRTLRTRDPHG

SEQ ID NO: 11037 - protein, 9 aa, Brucella spp.
YTEDAETGR

SEQ ID NO: 11038 - protein, 8 aa, Brucella spp.
TNGKGPRL

SEQ ID NO: 11039 - protein, 8 aa, Brucella spp.
ERGPGRHG

SEQ ID NO: 11040 - protein, 4 aa, Brucella spp.
PDGH

SEQ ID NO: 11041 - protein, 7 aa, Brucella spp.
QTVDPDL

SEQ ID NO: 11042 - protein, 7 aa, Brucella spp.
KDPQRQT

SEQ ID NO: 11043 - protein, 8 aa, Brucella spp.
GAPAPKSW

SEQ ID NO: 11044 - protein, 8 aa, Brucella spp.
GGRRIAEK

SEQ ID NO: 11045 - protein, 13 aa, Brucella spp.
VTQGKNFDATGSI

SEQ ID NO: 11046 - protein, 5 aa, Brucella spp.
DESQI

SEQ ID NO: 11047 - protein, 11 aa, Brucella spp.
NGEVRQQDRTS

SEQ ID NO: 11048 - protein, 9 aa, Brucella spp.
TPTGAGARF

SEQ ID NO: 11049 - protein, 7 aa, Brucella spp.
LKQGRAQ

SEQ ID NO: 11050 - protein, 6 aa, Brucella spp.
EHAPND

SEQ ID NO: 11051 - protein, 9 aa, Brucella spp.
AMTGSASHP

SEQ ID NO: 11052 - protein, 6 aa, Brucella spp.
VRPPVG

SEQ ID NO: 11053 - protein, 6 aa, Brucella spp.
REQAEA

SEQ ID NO: 11054 - protein, 6 aa, Brucella spp.
YPPHGV

SEQ ID NO: 11055 - protein, 5 aa, Brucella spp.
SALAR

SEQ ID NO: 11056 - protein, 4 aa, Brucella spp.
RAGL

SEQ ID NO: 11057 - protein, 6 aa, Brucella spp.
ATTEGV

SEQ ID NO: 11058 - protein, 13 aa, Brucella spp.
LGKPGAQEVQDAV

SEQ ID NO: 11059 - protein, 4 aa, Brucella spp.
AGIL

SEQ ID NO: 11060 - protein, 16 aa, Brucella spp.
KTTEPGRPASPDARVY

SEQ ID NO: 11061 - protein, 9 aa, Brucella spp.
ATPAFASPE

SEQ ID NO: 11062 - protein, 5 aa, Brucella spp.
KLGAK

SEQ ID NO: 11063 - protein, 15 aa, Brucella spp.
NVQSADGNEEKQVKQ

SEQ ID NO: 11064 - protein, 7 aa, Brucella spp.
DAKASGI

SEQ ID NO: 11065 - protein, 7 aa, Brucella spp.
KAKPEGN

SEQ ID NO: 11066 - protein, 8 aa, Brucella spp.
GSPTDNNA

SEQ ID NO: 11067 - protein, 16 aa, Brucella spp.
RAGQEKALKEAMDSGK

SEQ ID NO: 11068 - protein, 6 aa, Brucella spp.
WSPTEA

SEQ ID NO: 11069 - protein, 6 aa, Brucella spp.
TATQNK

SEQ ID NO: 11070 - protein, 11 aa, Brucella spp.
ASNDGTAGGAI

SEQ ID NO: 11071 - protein, 17 aa, Brucella spp.
QGLAGKTAVSGQDSDLA

SEQ ID NO: 11072 - protein, 6 aa, Brucella spp.
DGTQTV

SEQ ID NO: 11073 - protein, 16 aa, Brucella spp.
EKPEFNGKINNGSKDV

SEQ ID NO: 11074 - protein, 6 aa, Brucella spp.
TAVTKD

SEQ ID NO: 11075 - protein, 27 aa, Brucella spp.
PVPPKPLTPVAGEAAEKPAAVGQEQAE

SEQ ID NO: 11076 - protein, 17 aa, Brucella spp.
EEKRAAFEAGREDGHRE

SEQ ID NO: 11077 - protein, 7 aa, Brucella spp.
EQSLSGQ

SEQ ID NO: 11078 - protein, 11 aa, Brucella spp.
EGEAPEISGPA

SEQ ID NO: 11079 - protein, 9 aa, Brucella spp.
FSETASNEL

SEQ ID NO: 11080 - protein, 14 aa, Brucella spp.
VAGGTACARAQPEM

SEQ ID NO: 11081 - protein, 5 aa, Brucella spp.
AGKPE

SEQ ID NO: 11082 - protein, 8 aa, Brucella spp.
MSRAQPEV

SEQ ID NO: 11083 - protein, 4 aa, Brucella spp.
KPEN

SEQ ID NO: 11084 - protein, 6 aa, Brucella spp.
GNPEAV

SEQ ID NO: 11085 - protein, 8 aa, Brucella spp.
KTDTVPQE

SEQ ID NO: 11086 - protein, 6 aa, Brucella spp.
YASGQT

SEQ ID NO: 11087 - protein, 6 aa, Brucella spp.
PEVPAE

SEQ ID NO: 11088 - protein, 4 aa, Brucella spp.
EAPG

SEQ ID NO: 11089 - protein, 8 aa, Brucella spp.
AKRGAADK

SEQ ID NO: 11090 - protein, 6 aa, Brucella spp.
DRIGDE

SEQ ID NO: 11091 - protein, 8 aa, Brucella spp.
VDGQTERA

SEQ ID NO: 11092 - protein, 8 aa, Brucella spp.
NADPTRAN

SEQ ID NO: 11093 - protein, 14 aa, Brucella spp.
ASDVASDSAGSALR

SEQ ID NO: 11094 - protein, 10 aa, Brucella spp.
SPDHLQEPDR

SEQ ID NO: 11095 - protein, 4 aa, Brucella spp.
AETV

SEQ ID NO: 11096 - protein, 19 aa, Brucella spp.
RAPDTTSRAKRSADEREVP

SEQ ID NO: 11097 - protein, 12 aa, Brucella spp.
APQLPAQQTLSA

SEQ ID NO: 11098 - protein, 21 aa, Brucella spp.
NPARTRSEADLQKTMENARRK

SEQ ID NO: 11099 - protein, 25 aa, Brucella spp.
SLARNSSTQARVAGDEQDGGSDPAT

SEQ ID NO: 11100 - protein, 31 aa, Brucella spp.
KPHGKVDASGKDEAEAKSDEKEAGDGSGQKP

SEQ ID NO: 11101 - protein, 23 aa, Brucella spp.
ALPGQQHGEGGFSVEEKAGNPAC

SEQ ID NO: 11102 - protein, 5 aa, Brucella spp.
VSEPG

SEQ ID NO: 11103 - protein, 7 aa, Brucella spp.
PAGIDKA

SEQ ID NO: 11104 - protein, 15 aa, Brucella spp.
AAEFAGDDEKRPLRE

SEQ ID NO: 11105 - protein, 8 aa, Brucella spp.
KAAQTNGD

SEQ ID NO: 11106 - protein, 11 aa, Brucella spp.
RAGQASGEAAL

SEQ ID NO: 11107 - protein, 18 aa, Brucella spp.
SGDISGNKLAEGAAADVA

SEQ ID NO: 11108 - protein, 17 aa, Brucella spp.
GIKAPKPATDHEPAKGM

SEQ ID NO: 11109 - protein, 23 aa, Brucella spp.
PQQAAAKSTVPAEAKAAAGMPEA

SEQ ID NO: 11110 - protein, 4 aa, Brucella spp.
RSFG

SEQ ID NO: 11111 - protein, 6 aa, Brucella spp.
KSHAAE

SEQ ID NO: 11112 - protein, 9 aa, Brucella spp.
AGVGDDTKI

SEQ ID NO: 11113 - protein, 10 aa, Brucella spp.
DRNAQGAAQH

SEQ ID NO: 11114 - protein, 17 aa, Brucella spp.
AAQNAGQQQASAQQQGH

SEQ ID NO: 11115 - protein, 13 aa, Brucella spp.
QQGSQGRGGEAQA

SEQ ID NO: 11116 - protein, 44 aa, Brucella spp.
SGRSGGEGGRNGGSGQAGREHANSQAKPENGRGAPHIGGRGLVV

SEQ ID NO: 11117 - protein, 13 aa, Brucella spp.
SSLAATSKQTSVV

SEQ ID NO: 11118 - protein, 16 aa, Brucella spp.
RNISGAKDADYSRRTA

SEQ ID NO: 11119 - protein, 6 aa, Brucella spp.
VSGPYG

SEQ ID NO: 11120 - protein, 5 aa, Brucella spp.
RSADE

SEQ ID NO: 11121 - protein, 14 aa, Brucella spp.
SNSAASASSTLADG

SEQ ID NO: 11122 - protein, 12 aa, Brucella spp.
ADNYSGSPSGLI

SEQ ID NO: 11123 - protein, 11 aa, Brucella spp.
VASPSNSALGD

SEQ ID NO: 11124 - protein, 13 aa, Brucella spp.
SLRNDADREIADS

SEQ ID NO: 11125 - protein, 15 aa, Brucella spp.
KANQNVVGGTRMGRD

SEQ ID NO: 11126 - protein, 5 aa, Brucella spp.
TPGVA

SEQ ID NO: 11127 - protein, 5 aa, Brucella spp.
GKAVT

SEQ ID NO: 11128 - protein, 8 aa, Brucella spp.
DQPFGTGR

SEQ ID NO: 11129 - protein, 13 aa, Brucella spp.
ESDQTGSSPDQTG

SEQ ID NO: 11130 - protein, 10 aa, Brucella spp.
GSPAIPGAGL

SEQ ID NO: 11131 - protein, 6 aa, Brucella spp.
SAGIAG

SEQ ID NO: 11132 - protein, 5 aa, Brucella spp.
SEGGS

SEQ ID NO: 11133 - protein, 10 aa, Brucella spp.
DGGANGANYK

SEQ ID NO: 11134 - protein, 8 aa, Brucella spp.
QGAAGFSD

SEQ ID NO: 11135 - protein, 11 aa, Brucella spp.
AGISSSSSLIG

SEQ ID NO: 11136 - protein, 13 aa, Brucella spp.
GKRQKANSEFTYN

SEQ ID NO: 11137 - protein, 8 aa, Brucella spp.
GTVASQAD

SEQ ID NO: 11138 - protein, 7 aa, Brucella spp.
NATGVDI

SEQ ID NO: 11139 - protein, 7 aa, Brucella spp.
SYQASSR

SEQ ID NO: 11140 - protein, 5 aa, Brucella spp.
NKAEM

SEQ ID NO: 11141 - protein, 9 aa, Brucella spp.
AQQEATTGT

SEQ ID NO: 11142 - protein, 10 aa, Brucella spp.
LGSRTGQTVS

SEQ ID NO: 11143 - protein, 10 aa, Brucella spp.
TATQTAAGKI

SEQ ID NO: 11144 - protein, 20 aa, Brucella spp.
AGANNSGETAKTVAKSARSM

SEQ ID NO: 11145 - protein, 19 aa, Brucella spp.
DVKPISDYADGSTAQNAVR

SEQ ID NO: 11146 - protein, 9 aa, Brucella spp.
QVANISGDE

SEQ ID NO: 11147 - protein, 31 aa, Brucella spp.
WSDASDTRIKSRISPTETADTSISANADGFR

SEQ ID NO: 11148 - protein, 12 aa, Brucella spp.
AVTETTSEQTTL

SEQ ID NO: 11149 - protein, 12 aa, Brucella spp.
QSRTEAATTRIA

SEQ ID NO: 11150 - protein, 9 aa, Brucella spp.
VDPYDAATR

SEQ ID NO: 11151 - protein, 6 aa, Brucella spp.
TQIETS

SEQ ID NO: 11152 - protein, 9 aa, Brucella spp.
DMASAKERE

SEQ ID NO: 11153 - protein, 11 aa, Brucella spp.
RANGAESREGI

SEQ ID NO: 11154 - protein, 11 aa, Brucella spp.
LGSEENALPKE

SEQ ID NO: 11155 - protein, 9 aa, Brucella spp.
IRQGESNDY

SEQ ID NO: 11156 - protein, 21 aa, Brucella spp.
TNSASTASNSTSAANKASVDY

SEQ ID NO: 11157 - protein, 13 aa, Brucella spp.
QNQDPTQPMDPTQ

SEQ ID NO: 11158 - protein, 6 aa, Brucella spp.
SLTQAE

SEQ ID NO: 11159 - protein, 9 aa, Brucella spp.
TNADGSISG

SEQ ID NO: 11160 - protein, 4 aa, Brucella spp.
TIQS

SEQ ID NO: 11161 - protein, 14 aa, Brucella spp.
DGKTLTIGEGVRIS

SEQ ID NO: 11162 - protein, 4 aa, Brucella spp.
AGQP

SEQ ID NO: 11163 - protein, 17 aa, Brucella spp.
YSGSPADSITENEPQAT

SEQ ID NO: 11164 - protein, 4 aa, Brucella spp.
RFRP

SEQ ID NO: 11165 - protein, 5 aa, Brucella spp.
DVSAS

SEQ ID NO: 11166 - protein, 10 aa, Brucella spp.
VEAGPGGFGG

SEQ ID NO: 11167 - protein, 10 aa, Brucella spp.
SYSDTKSVEK

SEQ ID NO: 11168 - protein, 20 aa, Brucella spp.
HAQPGGRNRKADAEPAAQSE

SEQ ID NO: 11169 - protein, 13 aa, Brucella spp.
SEDIARAEGMNPA

SEQ ID NO: 11170 - protein, 9 aa, Brucella spp.
RRFASTPEQ

SEQ ID NO: 11171 - protein, 8 aa, Brucella spp.
DTPSGPSI

SEQ ID NO: 11172 - protein, 14 aa, Brucella spp.
NKGRETSPKRIAGQ

SEQ ID NO: 11173 - protein, 11 aa, Brucella spp.
QNGAGKSTAAK

SEQ ID NO: 11174 - protein, 4 aa, Brucella spp.
DEGM

SEQ ID NO: 11175 - protein, 6 aa, Brucella spp.
PLPRKE

SEQ ID NO: 11176 - protein, 11 aa, Brucella spp.
AETAHLSGGEF

SEQ ID NO: 11177 - protein, 4 aa, Brucella spp.
DDTS

SEQ ID NO: 11178 - protein, 12 aa, Brucella spp.
SGTPRDVTSSPE

SEQ ID NO: 11179 - protein, 16 aa, Brucella spp.
DGTTADPIAGSTMGPR

SEQ ID NO: 11180 - protein, 8 aa, Brucella spp.
SLAGEREG

SEQ ID NO: 11181 - protein, 6 aa, Brucella spp.
GAGSEH

SEQ ID NO: 11182 - protein, 8 aa, Brucella spp.
KPSDAEAI

SEQ ID NO: 11183 - protein, 7 aa, Brucella spp.
IDTLGEG

SEQ ID NO: 11184 - protein, 5 aa, Brucella spp.
DAKGL

SEQ ID NO: 11185 - protein, 8 aa, Brucella spp.
REGGPFEA

SEQ ID NO: 11186 - protein, 32 aa, Brucella spp.
DHGHGGSHEEEHDAHGSGDHDHAAEVAEEGHE

SEQ ID NO: 11187 - protein, 24 aa, Brucella spp.
KTLGESDPEHAAQYEKNAKAYGEK

SEQ ID NO: 11188 - protein, 6 aa, Brucella spp.
LKPVKD

SEQ ID NO: 11189 - protein, 15 aa, Brucella spp.
GSITVSPEKAPGAAR

SEQ ID NO: 11190 - protein, 9 aa, Brucella spp.
DGTKARTGV

SEQ ID NO: 11191 - protein, 10 aa, Brucella spp.
AELKDGPDLY

SEQ ID NO: 11192 - protein, 11 aa, Brucella spp.
SAPTKKARRLS

SEQ ID NO: 11193 - protein, 7 aa, Brucella spp.
KGEDCEA

SEQ ID NO: 11194 - protein, 9 aa, Brucella spp.
RGAKYPAEH

SEQ ID NO: 11195 - protein, 13 aa, Brucella spp.
DPTNAFNPGLGQT

SEQ ID NO: 11196 - protein, 9 aa, Brucella spp.
KRQTSPSEV

SEQ ID NO: 11197 - protein, 5 aa, Brucella spp.
RHNGA

SEQ ID NO: 11198 - protein, 11 aa, Brucella spp.
PTKDIRSTWGS

SEQ ID NO: 11199 - protein, 9 aa, Brucella spp.
KTNTPEWGH

SEQ ID NO: 11200 - protein, 18 aa, Brucella spp.
PYDTQLSAGGSSGGTAAA

SEQ ID NO: 11201 - protein, 4 aa, Brucella spp.
GSDM

SEQ ID NO: 11202 - protein, 7 aa, Brucella spp.
LSPFGQK

SEQ ID NO: 11203 - protein, 13 aa, Brucella spp.
GFATNHAPADLRG

SEQ ID NO: 11204 - protein, 5 aa, Brucella spp.
PPFSS

SEQ ID NO: 11205 - protein, 8 aa, Brucella spp.
WEKPETRK

SEQ ID NO: 11206 - protein, 6 aa, Brucella spp.
GAGLTA

SEQ ID NO: 11207 - protein, 5 aa, Brucella spp.
GQPMD

SEQ ID NO: 11208 - protein, 7 aa, Brucella spp.
QRGRPTG

SEQ ID NO: 11209 - protein, 6 aa, Brucella spp.
ASGADA

SEQ ID NO: 11210 - protein, 5 aa, Brucella spp.
QMPSK

SEQ ID NO: 11211 - protein, 5 aa, Brucella spp.
EVLPG

SEQ ID NO: 11212 - protein, 5 aa, Brucella spp.
QPIPT

SEQ ID NO: 11213 - protein, 8 aa, Brucella spp.
LKGPWPDG

SEQ ID NO: 11214 - protein, 13 aa, Brucella spp.
GGITPNPTYEETC

SEQ ID NO: 11215 - protein, 17 aa, Brucella spp.
HDPTQGMRQGNDIGTTY

SEQ ID NO: 11216 - protein, 29 aa, Brucella spp.
AVAEKSRDAYSQALASRGLGPVTTQITDA

SEQ ID NO: 11217 - protein, 6 aa, Brucella spp.
KNPDGY

SEQ ID NO: 11218 - protein, 8 aa, Brucella spp.
KKETSTAS

SEQ ID NO: 11219 - protein, 7 aa, Brucella spp.
KERGATN

SEQ ID NO: 11220 - protein, 4 aa, Brucella spp.
EGIE

SEQ ID NO: 11221 - protein, 12 aa, Brucella spp.
RARQMERSERMS

SEQ ID NO: 11222 - protein, 5 aa, Brucella spp.
LGPSY

SEQ ID NO: 11223 - protein, 7 aa, Brucella spp.
EGSLGRK

SEQ ID NO: 11224 - protein, 8 aa, Brucella spp.
KDGAPQKV

SEQ ID NO: 11225 - protein, 5 aa, Brucella spp.
SQTTR

SEQ ID NO: 11226 - protein, 10 aa, Brucella spp.
ENIKGDEGFR

SEQ ID NO: 11227 - protein, 5 aa, Brucella spp.
ERTGR

SEQ ID NO: 11228 - protein, 6 aa, Brucella spp.
LDKQQR

SEQ ID NO: 11229 - protein, 9 aa, Brucella spp.
IHDQPAETI

SEQ ID NO: 11230 - protein, 5 aa, Brucella spp.
LGPQG

SEQ ID NO: 11231 - protein, 4 aa, Brucella spp.
KESA

SEQ ID NO: 11232 - protein, 16 aa, Brucella spp.
DATAEAIGRAEAQHSR

SEQ ID NO: 11233 - protein, 5 aa, Brucella spp.
AYKTP

SEQ ID NO: 11234 - protein, 7 aa, Brucella spp.
REDEQDV

SEQ ID NO: 11235 - protein, 5 aa, Brucella spp.
GLADD

SEQ ID NO: 11236 - protein, 8 aa, Brucella spp.
NPATRRNR

SEQ ID NO: 11237 - protein, 19 aa, Brucella spp.
PEKGEMAESGEAGTGRMSE

SEQ ID NO: 11238 - protein, 9 aa, Brucella spp.
SPQAKPLAG

SEQ ID NO: 11239 - protein, 8 aa, Brucella spp.
SGPTYEPI

SEQ ID NO: 11240 - protein, 10 aa, Brucella spp.
NRSSGKQGHA

SEQ ID NO: 11241 - protein, 8 aa, Brucella spp.
VNIPDPEG

SEQ ID NO: 11242 - protein, 19 aa, Brucella spp.
RSANEAGQKIKKKPGEGAP

SEQ ID NO: 11243 - protein, 7 aa, Brucella spp.
HSKKRPG

SEQ ID NO: 11244 - protein, 18 aa, Brucella spp.
ETQDVAENARAKLEKKGA

SEQ ID NO: 11245 - protein, 16 aa, Brucella spp.
VSHGPGKDGVMGGDRN

SEQ ID NO: 11246 - protein, 8 aa, Brucella spp.
SKEDVAER

SEQ ID NO: 11247 - protein, 5 aa, Brucella spp.
KEEVR

SEQ ID NO: 11248 - protein, 7 aa, Brucella spp.
DTTNDRV

SEQ ID NO: 11249 - protein, 4 aa, Brucella spp.
SGNT

SEQ ID NO: 11250 - protein, 5 aa, Brucella spp.
GDEAY

SEQ ID NO: 11251 - protein, 6 aa, Brucella spp.
DAVQRG

SEQ ID NO: 11252 - protein, 5 aa, Brucella spp.
TAFTG

SEQ ID NO: 11253 - protein, 12 aa, Brucella spp.
IAPPENPPGTGT

SEQ ID NO: 11254 - protein, 11 aa, Brucella spp.
GSGPDKNLETN

SEQ ID NO: 11255 - protein, 4 aa, Brucella spp.
ARRG

SEQ ID NO: 11256 - protein, 8 aa, Brucella spp.
SSNIDPRS

SEQ ID NO: 11257 - protein, 4 aa, Brucella spp.
RQVE

SEQ ID NO: 11258 - protein, 7 aa, Brucella spp.
NRPGYRP

SEQ ID NO: 11259 - protein, 5 aa, Brucella spp.
NITGG

SEQ ID NO: 11260 - protein, 7 aa, Brucella spp.
FNPQRTA

SEQ ID NO: 11261 - protein, 8 aa, Brucella spp.
DRRFGERS

SEQ ID NO: 11262 - protein, 6 aa, Brucella spp.
MPKGHG

SEQ ID NO: 11263 - protein, 7 aa, Brucella spp.
PGVEPRG

SEQ ID NO: 11264 - protein, 9 aa, Brucella spp.
RSREQQAET

SEQ ID NO: 11265 - protein, 5 aa, Brucella spp.
EADTL

SEQ ID NO: 11266 - protein, 5 aa, Brucella spp.
KRSSL

SEQ ID NO: 11267 - protein, 5 aa, Brucella spp.
VPSFP

SEQ ID NO: 11268 - protein, 4 aa, Brucella spp.
APDN

SEQ ID NO: 11269 - protein, 5 aa, Brucella spp.
DPVPE

SEQ ID NO: 11270 - protein, 10 aa, Brucella spp.
DHAPSVGNAR

SEQ ID NO: 11271 - protein, 6 aa, Brucella spp.
SQAKRK

SEQ ID NO: 11272 - protein, 7 aa, Brucella spp.
NQAAAQI

SEQ ID NO: 11273 - protein, 8 aa, Brucella spp.
DGARASQY

SEQ ID NO: 11274 - protein, 4 aa, Brucella spp.
IETA

SEQ ID NO: 11275 - protein, 24 aa, Brucella spp.
DTAPAEGHGLGRQSMASTLEQSTA

SEQ ID NO: 11276 - protein, 6 aa, Brucella spp.
TEDDTP

SEQ ID NO: 11277 - protein, 12 aa, Brucella spp.
WQENRETFWRRA

SEQ ID NO: 11278 - protein, 4 aa, Brucella spp.
QSEW

SEQ ID NO: 11279 - protein, 19 aa, Brucella spp.
PGLTEQGHAEAKAAGQRLK

SEQ ID NO: 11280 - protein, 7 aa, Brucella spp.
GQPGLET

SEQ ID NO: 11281 - protein, 23 aa, Brucella spp.
LNERDYGDLSGLNKDDARAKWGE

SEQ ID NO: 11282 - protein, 15 aa, Brucella spp.
DVPPPGGESLKDTGA

SEQ ID NO: 11283 - protein, 4 aa, Brucella spp.
TPEQ

SEQ ID NO: 11284 - protein, 12 aa, Brucella spp.
DSTVASKEILSA

SEQ ID NO: 11285 - protein, 5 aa, Brucella spp.
GGRMG

SEQ ID NO: 11286 - protein, 19 aa, Brucella spp.
IERSGSPFLGKDAGEVTGI

SEQ ID NO: 11287 - protein, 5 aa, Brucella spp.
SPAAS

SEQ ID NO: 11288 - protein, 14 aa, Brucella spp.
TGCSAEDDEKIRAA

SEQ ID NO: 11289 - protein, 8 aa, Brucella spp.
AEALGPED

SEQ ID NO: 11290 - protein, 8 aa, Brucella spp.
VDAPSGTA

SEQ ID NO: 11291 - protein, 7 aa, Brucella spp.
AAARGRD

SEQ ID NO: 11292 - protein, 13 aa, Brucella spp.
VRDGYTGPRETGT

SEQ ID NO: 11293 - protein, 6 aa, Brucella spp.
GKKPGL

SEQ ID NO: 11294 - protein, 6 aa, Brucella spp.
DPGEAT

SEQ ID NO: 11295 - protein, 6 aa, Brucella spp.
GGSNGA

SEQ ID NO: 11296 - protein, 7 aa, Brucella spp.
DTRSGHL

SEQ ID NO: 11297 - protein, 20 aa, Brucella spp.
DQSEGRSNKIAKVSERTTPI

SEQ ID NO: 11298 - protein, 6 aa, Brucella spp.
HQPPGA

SEQ ID NO: 11299 - protein, 20 aa, Brucella spp.
EPRQRDLQGATELKAGPGEI

SEQ ID NO: 11300 - protein, 7 aa, Brucella spp.
AGETTAV

SEQ ID NO: 11301 - protein, 9 aa, Brucella spp.
GASGAGKST

SEQ ID NO: 11302 - protein, 7 aa, Brucella spp.
AGVTKQS

SEQ ID NO: 11303 - protein, 12 aa, Brucella spp.
RYGRPDASDEEI

SEQ ID NO: 11304 - protein, 22 aa, Brucella spp.
PQGYDTPVGENGVTLSGGQRQR

SEQ ID NO: 11305 - protein, 14 aa, Brucella spp.
TSALDNESEKRVQQ

SEQ ID NO: 11306 - protein, 6 aa, Brucella spp.
VEEGRH

SEQ ID NO: 11307 - protein, 20 aa, Brucella spp.
GKDDIITEQSEEALHTGEAR

SEQ ID NO: 11308 - protein, 6 aa, Brucella spp.
IGGTNA

SEQ ID NO: 11309 - protein, 8 aa, Brucella spp.
SNAEPKEF

SEQ ID NO: 11310 - protein, 4 aa, Brucella spp.
AIQP

SEQ ID NO: 11311 - protein, 8 aa, Brucella spp.
GPVDGDEI

SEQ ID NO: 11312 - protein, 9 aa, Brucella spp.
IGGKPEEAV

SEQ ID NO: 11313 - protein, 6 aa, Brucella spp.
PGTGLG

SEQ ID NO: 11314 - protein, 7 aa, Brucella spp.
VPGEGGH

SEQ ID NO: 11315 - protein, 8 aa, Brucella spp.
IGPRTERD

SEQ ID NO: 11316 - protein, 6 aa, Brucella spp.
GRVTGE

SEQ ID NO: 11317 - protein, 8 aa, Brucella spp.
KITPTLET

SEQ ID NO: 11318 - protein, 14 aa, Brucella spp.
SAGLDGSNPQAAET

SEQ ID NO: 11319 - protein, 8 aa, Brucella spp.
EDKAPNKA

SEQ ID NO: 11320 - protein, 7 aa, Brucella spp.
ARTPSRF

SEQ ID NO: 11321 - protein, 12 aa, Brucella spp.
VSTEGRRWRMRR

SEQ ID NO: 11322 - protein, 6 aa, Brucella spp.
DQKKDD

SEQ ID NO: 11323 - protein, 7 aa, Brucella spp.
TGTTGGL

SEQ ID NO: 11324 - protein, 10 aa, Brucella spp.
KSGPLGGDQQ

SEQ ID NO: 11325 - protein, 4 aa, Brucella spp.
PLPH

SEQ ID NO: 11326 - protein, 4 aa, Brucella spp.
TGKT

SEQ ID NO: 11327 - protein, 7 aa, Brucella spp.
FPRDART

SEQ ID NO: 11328 - protein, 8 aa, Brucella spp.
VSRSGSTI

SEQ ID NO: 11329 - protein, 7 aa, Brucella spp.
DKRSAAE

SEQ ID NO: 11330 - protein, 6 aa, Brucella spp.
RHRGSV

SEQ ID NO: 11331 - protein, 6 aa, Brucella spp.
ESGRQR

SEQ ID NO: 11332 - protein, 9 aa, Brucella spp.
AEAAKAEGI

SEQ ID NO: 11333 - protein, 18 aa, Brucella spp.
ADVNSPSAYARTKAEGEI

SEQ ID NO: 11334 - protein, 6 aa, Brucella spp.
GGETKL

SEQ ID NO: 11335 - protein, 6 aa, Brucella spp.
GGPDVQ

SEQ ID NO: 11336 - protein, 14 aa, Brucella spp.
NVVSEQAIKEGRTL

SEQ ID NO: 11337 - protein, 5 aa, Brucella spp.
ITPET

SEQ ID NO: 11338 - protein, 20 aa, Brucella spp.
TASHQISKEYSRQNAGKPAA

SEQ ID NO: 11339 - protein, 6 aa, Brucella spp.
GKSTLA

SEQ ID NO: 11340 - protein, 7 aa, Brucella spp.
LDTREMK

SEQ ID NO: 11341 - protein, 4 aa, Brucella spp.
RERG

SEQ ID NO: 11342 - protein, 7 aa, Brucella spp.
KAKNGED

SEQ ID NO: 11343 - protein, 7 aa, Brucella spp.
SQGVEAQ

SEQ ID NO: 11344 - protein, 10 aa, Brucella spp.
PAAEPERVKQ

SEQ ID NO: 11345 - protein, 13 aa, Brucella spp.
DAVEISAKTGLGI

SEQ ID NO: 11346 - protein, 13 aa, Brucella spp.
LPAPKEGDRNAPL

SEQ ID NO: 11347 - protein, 4 aa, Brucella spp.
KGQT

SEQ ID NO: 11348 - protein, 7 aa, Brucella spp.
AKYPVER

SEQ ID NO: 11349 - protein, 6 aa, Brucella spp.
DLGPGE

SEQ ID NO: 11350 - protein, 20 aa, Brucella spp.
EVADTRVGDTITEDRRPTEN

SEQ ID NO: 11351 - protein, 4 aa, Brucella spp.
KPAQ

SEQ ID NO: 11352 - protein, 13 aa, Brucella spp.
DGTHKELHNPADM

SEQ ID NO: 11353 - protein, 6 aa, Brucella spp.
ISKGYA

SEQ ID NO: 11354 - protein, 6 aa, Brucella spp.
DYREGD

SEQ ID NO: 11355 - protein, 8 aa, Brucella spp.
AAEKRGRA

SEQ ID NO: 11356 - protein, 8 aa, Brucella spp.
YGGDVTRK

SEQ ID NO: 11357 - protein, 11 aa, Brucella spp.
EKQKESKKRMR

SEQ ID NO: 11358 - protein, 11 aa, Brucella spp.
TQPPRPAGRRG

SEQ ID NO: 11359 - protein, 9 aa, Brucella spp.
RSPVHEKAE

SEQ ID NO: 11360 - protein, 10 aa, Brucella spp.
KSLKGAEEQD

SEQ ID NO: 11361 - protein, 5 aa, Brucella spp.
GDAET

SEQ ID NO: 11362 - protein, 7 aa, Brucella spp.
GLDTGPV

SEQ ID NO: 11363 - protein, 5 aa, Brucella spp.
TPDMT

SEQ ID NO: 11364 - protein, 10 aa, Brucella spp.
LQPQAEEGVT

SEQ ID NO: 11365 - protein, 7 aa, Brucella spp.
IDKAEAR

SEQ ID NO: 11366 - protein, 10 aa, Brucella spp.
SKPAKDVHNS

SEQ ID NO: 11367 - protein, 14 aa, Brucella spp.
RSTLGEGSGAPGTV

SEQ ID NO: 11368 - protein, 12 aa, Brucella spp.
LQRSGGKPLPAQ

SEQ ID NO: 11369 - protein, 10 aa, Brucella spp.
LTAGREEAGT

SEQ ID NO: 11370 - protein, 9 aa, Brucella spp.
VTPAEGGAL

SEQ ID NO: 11371 - protein, 13 aa, Brucella spp.
RPVFSDDNTPDIE

SEQ ID NO: 11372 - protein, 8 aa, Brucella spp.
RKSGNGPH

SEQ ID NO: 11373 - protein, 14 aa, Brucella spp.
VVPPGDEKDWKHPP

SEQ ID NO: 11374 - protein, 5 aa, Brucella spp.
GNIKG

SEQ ID NO: 11375 - protein, 10 aa, Brucella spp.
GDEEGPAVNG

SEQ ID NO: 11376 - protein, 6 aa, Brucella spp.
QRGESW

SEQ ID NO: 11377 - protein, 10 aa, Brucella spp.
VGEPTNPNAL

SEQ ID NO: 11378 - protein, 8 aa, Brucella spp.
RRGSLSGT

SEQ ID NO: 11379 - protein, 8 aa, Brucella spp.
EGTANFQA

SEQ ID NO: 11380 - protein, 16 aa, Brucella spp.
VGNKATNVIPNKATAS

SEQ ID NO: 11381 - protein, 16 aa, Brucella spp.
RAARDNRLRQGRETPI

SEQ ID NO: 11382 - protein, 20 aa, Brucella spp.
EAVTGKRPELSTSGGTSDAR

SEQ ID NO: 11383 - protein, 18 aa, Brucella spp.
FDERDGINTATRGEVREA

SEQ ID NO: 11384 - protein, 9 aa, Brucella spp.
VAEKQADGN

SEQ ID NO: 11385 - protein, 9 aa, Brucella spp.
KGGPGQSSW

SEQ ID NO: 11386 - protein, 5 aa, Brucella spp.
SKFDG

SEQ ID NO: 11387 - protein, 6 aa, Brucella spp.
QAGPTI

SEQ ID NO: 11388 - protein, 5 aa, Brucella spp.
IVDRA

SEQ ID NO: 11389 - protein, 13 aa, Brucella spp.
TMPGKNVPGENWG

SEQ ID NO: 11390 - protein, 17 aa, Brucella spp.
ADEKTRSKTSINELLRD

SEQ ID NO: 11391 - protein, 21 aa, Brucella spp.
SEEAVKQARTVPQTPQTEAPA

SEQ ID NO: 11392 - protein, 29 aa, Brucella spp.
RIPEPGGEAWAAKNEVQKKNLQANSHYYE

SEQ ID NO: 11393 - protein, 4 aa, Brucella spp.
SATT

SEQ ID NO: 11394 - protein, 21 aa, Brucella spp.
GGGPGVMEAGNRGAADVGAPT

SEQ ID NO: 11395 - protein, 8 aa, Brucella spp.
EQAPNAYV

SEQ ID NO: 11396 - protein, 7 aa, Brucella spp.
QGTISPA

SEQ ID NO: 11397 - protein, 13 aa, Brucella spp.
DEAWGHIKDFYKL

SEQ ID NO: 11398 - protein, 8 aa, Brucella spp.
PRDEARKV

SEQ ID NO: 11399 - protein, 6 aa, Brucella spp.
PDPALG

SEQ ID NO: 11400 - protein, 10 aa, Brucella spp.
GDRGHAERAA

SEQ ID NO: 11401 - protein, 10 aa, Brucella spp.
LTPKPERATY

SEQ ID NO: 11402 - protein, 7 aa, Brucella spp.
SDPEFTD

SEQ ID NO: 11403 - protein, 20 aa, Brucella spp.
KAAQAAADAVREAQAALAEE

SEQ ID NO: 11404 - protein, 5 aa, Brucella spp.
PPEGP

SEQ ID NO: 11405 - protein, 9 aa, Brucella spp.
GRSNVGKSS

SEQ ID NO: 11406 - protein, 15 aa, Brucella spp.
KGLARTSNTPGRTQE

SEQ ID NO: 11407 - protein, 11 aa, Brucella spp.
GYSGENGDLPP

SEQ ID NO: 11408 - protein, 8 aa, Brucella spp.
EAPKAQVD

SEQ ID NO: 11409 - protein, 8 aa, Brucella spp.
GIKKNDAE

SEQ ID NO: 11410 - protein, 6 aa, Brucella spp.
IKPAGV

SEQ ID NO: 11411 - protein, 11 aa, Brucella spp.
TSSEKGQGLDD

SEQ ID NO: 11412 - protein, 61 aa, Brucella spp.
PKTEAQREQARIEEQQRQAQQAAQNRQASSSTGDTPQMPANPDSIPGQGDTKAAGAPLTRD

SEQ ID NO: 11413 - protein, 7 aa, Brucella spp.
IAQSPRI

SEQ ID NO: 11414 - protein, 7 aa, Brucella spp.
DTPSLRG

SEQ ID NO: 11415 - protein, 10 aa, Brucella spp.
ETVSDKSPEI

SEQ ID NO: 11416 - protein, 5 aa, Brucella spp.
PSSLK

SEQ ID NO: 11417 - protein, 13 aa, Brucella spp.
TGNDATGAVPGPN

SEQ ID NO: 11418 - protein, 9 aa, Brucella spp.
NKLTPSTPV

SEQ ID NO: 11419 - protein, 4 aa, Brucella spp.
NDKN

SEQ ID NO: 11420 - protein, 10 aa, Brucella spp.
INNGGSTVSL

SEQ ID NO: 11421 - protein, 8 aa, Brucella spp.
NQPEHASA

SEQ ID NO: 11422 - protein, 8 aa, Brucella spp.
KIEDNKDI

SEQ ID NO: 11423 - protein, 9 aa, Brucella spp.
IPPQDEKFT

SEQ ID NO: 11424 - protein, 8 aa, Brucella spp.
NDRPRYQS

SEQ ID NO: 11425 - protein, 9 aa, Brucella spp.
VAPGQSQKI

SEQ ID NO: 11426 - protein, 6 aa, Brucella spp.
KSYKSM

SEQ ID NO: 11427 - protein, 12 aa, Brucella spp.
EKYADDKMKQQQ

SEQ ID NO: 11428 - protein, 7 aa, Brucella spp.
AAPDPTS

SEQ ID NO: 11429 - protein, 10 aa, Brucella spp.
NPTPPDPTQA

SEQ ID NO: 11430 - protein, 19 aa, Brucella spp.
ERTEEESNAAKTGDNPRVG

SEQ ID NO: 11431 - protein, 7 aa, Brucella spp.
KKNGNAV

SEQ ID NO: 11432 - protein, 7 aa, Brucella spp.
RDMAPST

SEQ ID NO: 11433 - protein, 26 aa, Brucella spp.
ITAKGERRSGGKRRTERPEPGPVNGK

SEQ ID NO: 11434 - protein, 9 aa, Brucella spp.
LAPDGLPRP

SEQ ID NO: 11435 - protein, 7 aa, Brucella spp.
FSAGPAA

SEQ ID NO: 11436 - protein, 5 aa, Brucella spp.
AKFGT

SEQ ID NO: 11437 - protein, 5 aa, Brucella spp.
TIGPS

SEQ ID NO: 11438 - protein, 10 aa, Brucella spp.
LPDNDRSARK

SEQ ID NO: 11439 - protein, 8 aa, Brucella spp.
DSAGNKIG

SEQ ID NO: 11440 - protein, 11 aa, Brucella spp.
LSGKLSDKYSP

SEQ ID NO: 11441 - protein, 13 aa, Brucella spp.
TPRARSGAASGML

SEQ ID NO: 11442 - protein, 22 aa, Brucella spp.
LPSNGARSGKTAEPLEDRRRYS

SEQ ID NO: 11443 - protein, 25 aa, Brucella spp.
SEDGEKREEQRPARGKTAKAPAIDE

SEQ ID NO: 11444 - protein, 6 aa, Brucella spp.
KESGRY

SEQ ID NO: 11445 - protein, 7 aa, Brucella spp.
DPPPIVP

SEQ ID NO: 11446 - protein, 11 aa, Brucella spp.
TETTGLNPAQE

SEQ ID NO: 11447 - protein, 6 aa, Brucella spp.
DDGSIG

SEQ ID NO: 11448 - protein, 10 aa, Brucella spp.
QQPSKPIPAE

SEQ ID NO: 11449 - protein, 6 aa, Brucella spp.
RTIPRD

SEQ ID NO: 11450 - protein, 5 aa, Brucella spp.
GFEGT

SEQ ID NO: 11451 - protein, 7 aa, Brucella spp.
HRAEDDC

SEQ ID NO: 11452 - protein, 9 aa, Brucella spp.
GKSGKTTPF

SEQ ID NO: 11453 - protein, 4 aa, Brucella spp.
SQRA

SEQ ID NO: 11454 - protein, 5 aa, Brucella spp.
NSPFE

SEQ ID NO: 11455 - protein, 12 aa, Brucella spp.
RWSDGTDGRPKS

SEQ ID NO: 11456 - protein, 6 aa, Brucella spp.
GEDELE

SEQ ID NO: 11457 - protein, 5 aa, Brucella spp.
LTTPQ

SEQ ID NO: 11458 - protein, 6 aa, Brucella spp.
ANTAYS

SEQ ID NO: 11459 - protein, 9 aa, Brucella spp.
RSKSAHDEP

SEQ ID NO: 11460 - protein, 5 aa, Brucella spp.
DKPVE

SEQ ID NO: 11461 - protein, 8 aa, Brucella spp.
RVRRKEPA

SEQ ID NO: 11462 - protein, 8 aa, Brucella spp.
IAPAAGEN

SEQ ID NO: 11463 - protein, 8 aa, Brucella spp.
PAASPAVS

SEQ ID NO: 11464 - protein, 22 aa, Brucella spp.
LSRAEEADAGENQAGLPSGRAV

SEQ ID NO: 11465 - protein, 6 aa, Brucella spp.
APDQTM

SEQ ID NO: 11466 - protein, 6 aa, Brucella spp.
ADREAG

SEQ ID NO: 11467 - protein, 12 aa, Brucella spp.
PLPGAKPALRRS

SEQ ID NO: 11468 - protein, 13 aa, Brucella spp.
AYAPESGATEEPQ

SEQ ID NO: 11469 - protein, 5 aa, Brucella spp.
AARSR

SEQ ID NO: 11470 - protein, 12 aa, Brucella spp.
LPSGEKLEAHSG

SEQ ID NO: 11471 - protein, 18 aa, Brucella spp.
DNPRYVSQKNRGPTPPHT

SEQ ID NO: 11472 - protein, 11 aa, Brucella spp.
PVDGNNRYNRD

SEQ ID NO: 11473 - protein, 6 aa, Brucella spp.
RGDSNG

SEQ ID NO: 11474 - protein, 12 aa, Brucella spp.
PSSKPARIASLF

SEQ ID NO: 11475 - protein, 7 aa, Brucella spp.
SSSKGYF

SEQ ID NO: 11476 - protein, 5 aa, Brucella spp.
ELPDG

SEQ ID NO: 11477 - protein, 16 aa, Brucella spp.
NGDRTSKQPQSRRSDC

SEQ ID NO: 11478 - protein, 10 aa, Brucella spp.
PESGTVNRPL

SEQ ID NO: 11479 - protein, 18 aa, Brucella spp.
RLPSNRSPRAPPFKLSIA

SEQ ID NO: 11480 - protein, 4 aa, Brucella spp.
GNTI

SEQ ID NO: 11481 - protein, 13 aa, Brucella spp.
PRSPQQKAYFPED

SEQ ID NO: 11482 - protein, 7 aa, Brucella spp.
RREGGGL

SEQ ID NO: 11483 - protein, 4 aa, Brucella spp.
AFGN

SEQ ID NO: 11484 - protein, 8 aa, Brucella spp.
PSSPAARD

SEQ ID NO: 11485 - protein, 5 aa, Brucella spp.
SRYQP

SEQ ID NO: 11486 - protein, 12 aa, Brucella spp.
HHEKDGVGLTDE

SEQ ID NO: 11487 - protein, 12 aa, Brucella spp.
RAKAAGVDIDNA

SEQ ID NO: 11488 - protein, 6 aa, Brucella spp.
EREVPQ

SEQ ID NO: 11489 - protein, 5 aa, Brucella spp.
ADPAS

SEQ ID NO: 11490 - protein, 16 aa, Brucella spp.
QIEKTIRDARSRLPAD

SEQ ID NO: 11491 - protein, 5 aa, Brucella spp.
KEEFA

SEQ ID NO: 11492 - protein, 9 aa, Brucella spp.
DAGKRAGVD

SEQ ID NO: 11493 - protein, 15 aa, Brucella spp.
VANDRKAGIEEQTRD

SEQ ID NO: 11494 - protein, 8 aa, Brucella spp.
EAGTDRSK

SEQ ID NO: 11495 - protein, 8 aa, Brucella spp.
AENPPARA

SEQ ID NO: 11496 - protein, 4 aa, Brucella spp.
ADPD

SEQ ID NO: 11497 - protein, 6 aa, Brucella spp.
TPRPGQ

SEQ ID NO: 11498 - protein, 8 aa, Brucella spp.
GQLGADPV

SEQ ID NO: 11499 - protein, 4 aa, Brucella spp.
WPAE

SEQ ID NO: 11500 - protein, 15 aa, Brucella spp.
KPALRPRGEAIALRK

SEQ ID NO: 11501 - protein, 11 aa, Brucella spp.
ARLTGDAVTPK

SEQ ID NO: 11502 - protein, 22 aa, Brucella spp.
AATGAASSAFADPLEAKTTAYK

SEQ ID NO: 11503 - protein, 10 aa, Brucella spp.
EKLTPQNAVT

SEQ ID NO: 11504 - protein, 15 aa, Brucella spp.
TDKSDPSANSGSFKP

SEQ ID NO: 11505 - protein, 6 aa, Brucella spp.
KQPKEF

SEQ ID NO: 11506 - protein, 6 aa, Brucella spp.
VEPLGS

SEQ ID NO: 11507 - protein, 8 aa, Brucella spp.
PDEMPGQT

SEQ ID NO: 11508 - protein, 10 aa, Brucella spp.
ETLPNANGAP

SEQ ID NO: 11509 - protein, 14 aa, Brucella spp.
KQPPTSWNRQAANE

SEQ ID NO: 11510 - protein, 17 aa, Brucella spp.
AVDHPRWSQATERRIGE

SEQ ID NO: 11511 - protein, 9 aa, Brucella spp.
GSDRRPTLP

SEQ ID NO: 11512 - protein, 4 aa, Brucella spp.
YGEE

SEQ ID NO: 11513 - protein, 6 aa, Brucella spp.
HEQHGP

SEQ ID NO: 11514 - protein, 4 aa, Brucella spp.
ALPA

SEQ ID NO: 11515 - protein, 8 aa, Brucella spp.
DTKGTQSL

SEQ ID NO: 11516 - protein, 6 aa, Brucella spp.
HGGNSP

SEQ ID NO: 11517 - protein, 6 aa, Brucella spp.
ITPEEK

SEQ ID NO: 11518 - protein, 10 aa, Brucella spp.
RNFPNAQSQF

SEQ ID NO: 11519 - protein, 19 aa, Brucella spp.
NPDGVAGNAIAASAQAGEK

SEQ ID NO: 11520 - protein, 9 aa, Brucella spp.
QGKRSRSSC

SEQ ID NO: 11521 - protein, 13 aa, Brucella spp.
RTHAGESLCPSGG

SEQ ID NO: 11522 - protein, 6 aa, Brucella spp.
TRPEEI

SEQ ID NO: 11523 - protein, 9 aa, Brucella spp.
FDEGESRFG

SEQ ID NO: 11524 - protein, 4 aa, Brucella spp.
DTTR

SEQ ID NO: 11525 - protein, 7 aa, Brucella spp.
QGQGGSI

SEQ ID NO: 11526 - protein, 13 aa, Brucella spp.
GERPQKGAAAYSM

SEQ ID NO: 11527 - protein, 20 aa, Brucella spp.
EEQLQGPAAGYLKGRNPMRR

SEQ ID NO: 11528 - protein, 7 aa, Brucella spp.
LGDPNDL

SEQ ID NO: 11529 - protein, 5 aa, Brucella spp.
ASRYM

SEQ ID NO: 11530 - protein, 4 aa, Brucella spp.
NYAS

SEQ ID NO: 11531 - protein, 5 aa, Brucella spp.
QTVSS

SEQ ID NO: 11532 - protein, 8 aa, Brucella spp.
QRVESEAR

SEQ ID NO: 11533 - protein, 5 aa, Brucella spp.
TGLPN

SEQ ID NO: 11534 - protein, 9 aa, Brucella spp.
RPHQDQNSK

SEQ ID NO: 11535 - protein, 5 aa, Brucella spp.
LGHHT

SEQ ID NO: 11536 - protein, 6 aa, Brucella spp.
SLDPQR

SEQ ID NO: 11537 - protein, 5 aa, Brucella spp.
SSEVN

SEQ ID NO: 11538 - protein, 9 aa, Brucella spp.
EAKGEENRQ

SEQ ID NO: 11539 - protein, 9 aa, Brucella spp.
TKYRSRQKL

SEQ ID NO: 11540 - protein, 5 aa, Brucella spp.
NNDIA

SEQ ID NO: 11541 - protein, 6 aa, Brucella spp.
KSGLPA

SEQ ID NO: 11542 - protein, 5 aa, Brucella spp.
DRNKT

SEQ ID NO: 11543 - protein, 6 aa, Brucella spp.
FGTGYS

SEQ ID NO: 11544 - protein, 4 aa, Brucella spp.
TSDR

SEQ ID NO: 11545 - protein, 6 aa, Brucella spp.
GVETEE

SEQ ID NO: 11546 - protein, 10 aa, Brucella spp.
SHPTTSRQGN

SEQ ID NO: 11547 - protein, 5 aa, Brucella spp.
GRMSG

SEQ ID NO: 11548 - protein, 4 aa, Brucella spp.
GSSG

SEQ ID NO: 11549 - protein, 26 aa, Brucella spp.
FGGDTSSAAGGEVEQRPVKQGSADDA

SEQ ID NO: 11550 - protein, 5 aa, Brucella spp.
KAEGV

SEQ ID NO: 11551 - protein, 4 aa, Brucella spp.
SEFA

SEQ ID NO: 11552 - protein, 15 aa, Brucella spp.
DVTNPAAKTDPKSPI

SEQ ID NO: 11553 - protein, 7 aa, Brucella spp.
GSGYAGV

SEQ ID NO: 11554 - protein, 7 aa, Brucella spp.
PEGTVAQ

SEQ ID NO: 11555 - protein, 6 aa, Brucella spp.
LPEEAG

SEQ ID NO: 11556 - protein, 9 aa, Brucella spp.
VASSSQPER

SEQ ID NO: 11557 - protein, 8 aa, Brucella spp.
KRGKPAPD

SEQ ID NO: 11558 - protein, 5 aa, Brucella spp.
MGVDP

SEQ ID NO: 11559 - protein, 12 aa, Brucella spp.
YTGGGHSYDGHA

SEQ ID NO: 11560 - protein, 16 aa, Brucella spp.
YNVRGSAYGKAGRYKE

SEQ ID NO: 11561 - protein, 11 aa, Brucella spp.
GDNNKAVQDYS

SEQ ID NO: 11562 - protein, 4 aa, Brucella spp.
NPQY

SEQ ID NO: 11563 - protein, 9 aa, Brucella spp.
RTTDGRAYH

SEQ ID NO: 11564 - protein, 13 aa, Brucella spp.
LNSTAPEPYNGRG

SEQ ID NO: 11565 - protein, 4 aa, Brucella spp.
AESW

SEQ ID NO: 11566 - protein, 13 aa, Brucella spp.
HNGDKAKAANSYA

SEQ ID NO: 11567 - protein, 16 aa, Brucella spp.
DPKYKPAKDGLARTRG

SEQ ID NO: 11568 - protein, 5 aa, Brucella spp.
GGLAQ

SEQ ID NO: 11569 - protein, 5 aa, Brucella spp.
RSMGA

SEQ ID NO: 11570 - protein, 8 aa, Brucella spp.
GAIGAGGL

SEQ ID NO: 11571 - protein, 20 aa, Brucella spp.
SAQGGAAADTLSTVKERGKV

SEQ ID NO: 11572 - protein, 13 aa, Brucella spp.
AGFSSPDDQGKWT

SEQ ID NO: 11573 - protein, 5 aa, Brucella spp.
FGDPD

SEQ ID NO: 11574 - protein, 12 aa, Brucella spp.
CTEQGTTTEQNV

SEQ ID NO: 11575 - protein, 4 aa, Brucella spp.
TTDA

SEQ ID NO: 11576 - protein, 13 aa, Brucella spp.
KEPLGPAVRQGDD

SEQ ID NO: 11577 - protein, 11 aa, Brucella spp.
AADLDSRKPDI

SEQ ID NO: 11578 - protein, 10 aa, Brucella spp.
SEGDNGQQLG

SEQ ID NO: 11579 - protein, 4 aa, Brucella spp.
IGEG

SEQ ID NO: 11580 - protein, 9 aa, Brucella spp.
GPGATNASI

SEQ ID NO: 11581 - protein, 7 aa, Brucella spp.
SDQVERE

SEQ ID NO: 11582 - protein, 6 aa, Brucella spp.
NGRPGP

SEQ ID NO: 11583 - protein, 8 aa, Brucella spp.
VSDAPAYK

SEQ ID NO: 11584 - protein, 7 aa, Brucella spp.
HPGGEQL

SEQ ID NO: 11585 - protein, 7 aa, Brucella spp.
GGWTQDA

SEQ ID NO: 11586 - protein, 5 aa, Brucella spp.
MGTSI

SEQ ID NO: 11587 - protein, 5 aa, Brucella spp.
EMTTQ

SEQ ID NO: 11588 - protein, 7 aa, Brucella spp.
LAPVADP

SEQ ID NO: 11589 - protein, 11 aa, Brucella spp.
DSANADYRDNI

SEQ ID NO: 11590 - protein, 4 aa, Brucella spp.
SPVI

SEQ ID NO: 11591 - protein, 9 aa, Brucella spp.
TNGAGNYSA

SEQ ID NO: 11592 - protein, 11 aa, Brucella spp.
SQLAPTNGSMG

SEQ ID NO: 11593 - protein, 6 aa, Brucella spp.
LTAPER

SEQ ID NO: 11594 - protein, 8 aa, Brucella spp.
LATAAQYG

SEQ ID NO: 11595 - protein, 16 aa, Brucella spp.
RTYPARISGTALANPD

SEQ ID NO: 11596 - protein, 5 aa, Brucella spp.
TADFA

SEQ ID NO: 11597 - protein, 8 aa, Brucella spp.
CEQSGKPA

SEQ ID NO: 11598 - protein, 6 aa, Brucella spp.
EALSPK

SEQ ID NO: 11599 - protein, 4 aa, Brucella spp.
GEAH

SEQ ID NO: 11600 - protein, 7 aa, Brucella spp.
CDDEGAA

SEQ ID NO: 11601 - protein, 10 aa, Brucella spp.
ACSGKGEAVD

SEQ ID NO: 11602 - protein, 4 aa, Brucella spp.
ASGR

SEQ ID NO: 11603 - protein, 9 aa, Brucella spp.
GSADGRDKM

SEQ ID NO: 11604 - protein, 10 aa, Brucella spp.
MQSAEKPTDS

SEQ ID NO: 11605 - protein, 12 aa, Brucella spp.
GGKPKPGETGVQ

SEQ ID NO: 11606 - protein, 11 aa, Brucella spp.
FAEDGGEEPEL

SEQ ID NO: 11607 - protein, 5 aa, Brucella spp.
PDGTP

SEQ ID NO: 11608 - protein, 6 aa, Brucella spp.
DHVTEK

SEQ ID NO: 11609 - protein, 5 aa, Brucella spp.
QAALG

SEQ ID NO: 11610 - protein, 5 aa, Brucella spp.
RIRRG

SEQ ID NO: 11611 - protein, 4 aa, Brucella spp.
SGEA

SEQ ID NO: 11612 - protein, 10 aa, Brucella spp.
DGVKTEAGDQ

SEQ ID NO: 11613 - protein, 13 aa, Brucella spp.
GQAAAEKITVRAL

SEQ ID NO: 11614 - protein, 13 aa, Brucella spp.
ASRNAGLDGTPSF

SEQ ID NO: 11615 - protein, 8 aa, Brucella spp.
TPPQGRFN

SEQ ID NO: 11616 - protein, 8 aa, Brucella spp.
KPPGATIS

SEQ ID NO: 11617 - protein, 4 aa, Brucella spp.
ERQG

SEQ ID NO: 11618 - protein, 9 aa, Brucella spp.
EAAAVGPAR

SEQ ID NO: 11619 - protein, 5 aa, Brucella spp.
RAAPI

SEQ ID NO: 11620 - protein, 6 aa, Brucella spp.
QTGPQT

SEQ ID NO: 11621 - protein, 4 aa, Brucella spp.
TDKG

SEQ ID NO: 11622 - protein, 19 aa, Brucella spp.
GSRMTVAGEEKMAEPDREY

SEQ ID NO: 11623 - protein, 6 aa, Brucella spp.
ERRSDV

SEQ ID NO: 11624 - protein, 5 aa, Brucella spp.
NPDNV

SEQ ID NO: 11625 - protein, 9 aa, Brucella spp.
QEELQSGRP

SEQ ID NO: 11626 - protein, 9 aa, Brucella spp.
QTGSDLSPC

SEQ ID NO: 11627 - protein, 8 aa, Brucella spp.
VRDGVREA

SEQ ID NO: 11628 - protein, 12 aa, Brucella spp.
QETGKRPTAGLD

SEQ ID NO: 11629 - protein, 6 aa, Brucella spp.
DKTTPA

SEQ ID NO: 11630 - protein, 8 aa, Brucella spp.
GERTGSGT

SEQ ID NO: 11631 - protein, 9 aa, Brucella spp.
SSAPSTGYC

SEQ ID NO: 11632 - protein, 7 aa, Brucella spp.
GTATTMN

SEQ ID NO: 11633 - protein, 13 aa, Brucella spp.
GSAAIPAPYRDRQ

SEQ ID NO: 11634 - protein, 5 aa, Brucella spp.
KPSDI

SEQ ID NO: 11635 - protein, 10 aa, Brucella spp.
SAIGGSTNAP

SEQ ID NO: 11636 - protein, 4 aa, Brucella spp.
KYGE

SEQ ID NO: 11637 - protein, 6 aa, Brucella spp.
PAGEYL

SEQ ID NO: 11638 - protein, 18 aa, Brucella spp.
VNGKTIGENCKNATIEDG

SEQ ID NO: 11639 - protein, 6 aa, Brucella spp.
YDQPLK

SEQ ID NO: 11640 - protein, 10 aa, Brucella spp.
SDAKDPNAFE

SEQ ID NO: 11641 - protein, 8 aa, Brucella spp.
GPIGYPGA

SEQ ID NO: 11642 - protein, 25 aa, Brucella spp.
DGRQSGTSGSPSILNASPEAAAGGG

SEQ ID NO: 11643 - protein, 4 aa, Brucella spp.
GRGT

SEQ ID NO: 11644 - protein, 7 aa, Brucella spp.
ELAERRK

SEQ ID NO: 11645 - protein, 12 aa, Brucella spp.
GYKYPESQTPWQ

SEQ ID NO: 11646 - protein, 12 aa, Brucella spp.
AVLGESRGDDGL

SEQ ID NO: 11647 - protein, 6 aa, Brucella spp.
AGFEPT

SEQ ID NO: 11648 - protein, 5 aa, Brucella spp.
GAPDD

SEQ ID NO: 11649 - protein, 4 aa, Brucella spp.
SRAG

SEQ ID NO: 11650 - protein, 15 aa, Brucella spp.
RQDETAPDVMRGEET

SEQ ID NO: 11651 - protein, 11 aa, Brucella spp.
EGAGTVDPNHD

SEQ ID NO: 11652 - protein, 6 aa, Brucella spp.
SLEAPE

SEQ ID NO: 11653 - protein, 8 aa, Brucella spp.
RKPTDQLA

SEQ ID NO: 11654 - protein, 7 aa, Brucella spp.
GRTLYGG

SEQ ID NO: 11655 - protein, 8 aa, Brucella spp.
PSDGTMGG

SEQ ID NO: 11656 - protein, 5 aa, Brucella spp.
LATAG

SEQ ID NO: 11657 - protein, 7 aa, Brucella spp.
RPEETEA

SEQ ID NO: 11658 - protein, 9 aa, Brucella spp.
NSPAPFTSI

SEQ ID NO: 11659 - protein, 6 aa, Brucella spp.
AKLAPK

SEQ ID NO: 11660 - protein, 4 aa, Brucella spp.
LNDV

SEQ ID NO: 11661 - protein, 4 aa, Brucella spp.
RAGA

SEQ ID NO: 11662 - protein, 8 aa, Brucella spp.
GGVSQNDF

SEQ ID NO: 11663 - protein, 20 aa, Brucella spp.
AADVQERAQQAVAAWDKIAG

SEQ ID NO: 11664 - protein, 5 aa, Brucella spp.
SSVGR

SEQ ID NO: 11665 - protein, 4 aa, Brucella spp.
LRES

SEQ ID NO: 11666 - protein, 5 aa, Brucella spp.
QSVGP

SEQ ID NO: 11667 - protein, 7 aa, Brucella spp.
GNRHAAK

SEQ ID NO: 11668 - protein, 7 aa, Brucella spp.
LSGVKTE

SEQ ID NO: 11669 - protein, 9 aa, Brucella spp.
NTATPKAGI

SEQ ID NO: 11670 - protein, 8 aa, Brucella spp.
SAYGGVGR

SEQ ID NO: 11671 - protein, 5 aa, Brucella spp.
NSEPH

SEQ ID NO: 11672 - protein, 5 aa, Brucella spp.
RSTGE

SEQ ID NO: 11673 - protein, 9 aa, Brucella spp.
RGNGGDRDF

SEQ ID NO: 11674 - protein, 7 aa, Brucella spp.
KPALKTG

SEQ ID NO: 11675 - protein, 7 aa, Brucella spp.
AKNAGCD

SEQ ID NO: 11676 - protein, 9 aa, Brucella spp.
VTEGASSTA

SEQ ID NO: 11677 - protein, 7 aa, Brucella spp.
TRPNSNF

SEQ ID NO: 11678 - protein, 12 aa, Brucella spp.
KTIGDGKPGPIA

SEQ ID NO: 11679 - protein, 6 aa, Brucella spp.
NGGGLT

SEQ ID NO: 11680 - protein, 6 aa, Brucella spp.
PQGASV

SEQ ID NO: 11681 - protein, 6 aa, Brucella spp.
ASDGPF

SEQ ID NO: 11682 - protein, 8 aa, Brucella spp.
GQATTLTR

SEQ ID NO: 11683 - protein, 5 aa, Brucella spp.
NGTTL

SEQ ID NO: 11684 - protein, 6 aa, Brucella spp.
TGKGTT

SEQ ID NO: 11685 - protein, 15 aa, Brucella spp.
PAENKSKSHCASAPD

SEQ ID NO: 11686 - protein, 8 aa, Brucella spp.
HTGTDVPD

SEQ ID NO: 11687 - protein, 5 aa, Brucella spp.
DNGKI

SEQ ID NO: 11688 - protein, 7 aa, Brucella spp.
NRDPAGV

SEQ ID NO: 11689 - protein, 9 aa, Brucella spp.
YPGQNTTTL

SEQ ID NO: 11690 - protein, 10 aa, Brucella spp.
DGEAPTEADI

SEQ ID NO: 11691 - protein, 10 aa, Brucella spp.
MGKTCDPGIE

SEQ ID NO: 11692 - protein, 9 aa, Brucella spp.
TAKAKGYTS

SEQ ID NO: 11693 - protein, 7 aa, Brucella spp.
YGRPQTG

SEQ ID NO: 11694 - protein, 7 aa, Brucella spp.
EAKADTL

SEQ ID NO: 11695 - protein, 9 aa, Brucella spp.
GRAVSGGNF

SEQ ID NO: 11696 - protein, 6 aa, Brucella spp.
KPGLNS

SEQ ID NO: 11697 - protein, 21 aa, Brucella spp.
KQMAHPASVDSTPTSANQEDH

SEQ ID NO: 11698 - protein, 7 aa, Brucella spp.
PLTTSAE

SEQ ID NO: 11699 - protein, 5 aa, Brucella spp.
ATLEE

SEQ ID NO: 11700 - protein, 4 aa, Brucella spp.
GTLS

SEQ ID NO: 11701 - protein, 10 aa, Brucella spp.
LAGPDDERQS

SEQ ID NO: 11702 - protein, 10 aa, Brucella spp.
AERRGPSADS

SEQ ID NO: 11703 - protein, 6 aa, Brucella spp.
TPEQAE

SEQ ID NO: 11704 - protein, 7 aa, Brucella spp.
DGTPYAN

SEQ ID NO: 11705 - protein, 9 aa, Brucella spp.
TAAATTAGM

SEQ ID NO: 11706 - protein, 13 aa, Brucella spp.
GFGGAAANEGQRR

SEQ ID NO: 11707 - protein, 4 aa, Brucella spp.
LEGF

SEQ ID NO: 11708 - protein, 7 aa, Brucella spp.
VTPDELD

SEQ ID NO: 11709 - protein, 10 aa, Brucella spp.
MSDEETKHMA

SEQ ID NO: 11710 - protein, 9 aa, Brucella spp.
ANLGDGTFN

SEQ ID NO: 11711 - protein, 12 aa, Brucella spp.
AAAGGKFGIGSD

SEQ ID NO: 11712 - protein, 9 aa, Brucella spp.
ANEKSTGRA

SEQ ID NO: 11713 - protein, 14 aa, Brucella spp.
GRPEDGLKKGASAD

SEQ ID NO: 11714 - protein, 4 aa, Brucella spp.
PHAK

SEQ ID NO: 11715 - protein, 26 aa, Brucella spp.
QVEGGRHRLRDEAERAFQKALGELLA

SEQ ID NO: 11716 - protein, 7 aa, Brucella spp.
RKRRSGS

SEQ ID NO: 11717 - protein, 4 aa, Brucella spp.
PQSQ

SEQ ID NO: 11718 - protein, 9 aa, Brucella spp.
LSGPADARR

SEQ ID NO: 11719 - protein, 15 aa, Brucella spp.
PAAAETDFAQNSPGP

SEQ ID NO: 11720 - protein, 7 aa, Brucella spp.
ATQEAAA

SEQ ID NO: 11721 - protein, 6 aa, Brucella spp.
DIAPGS

SEQ ID NO: 11722 - protein, 7 aa, Brucella spp.
WNADQPV

SEQ ID NO: 11723 - protein, 5 aa, Brucella spp.
YPGDS

SEQ ID NO: 11724 - protein, 6 aa, Brucella spp.
ERDLAA

SEQ ID NO: 11725 - protein, 7 aa, Brucella spp.
IAPTRTA

SEQ ID NO: 11726 - protein, 7 aa, Brucella spp.
AYGLGAS

SEQ ID NO: 11727 - protein, 9 aa, Brucella spp.
LQPGTEAAC

SEQ ID NO: 11728 - protein, 12 aa, Brucella spp.
ANGDEPGNAVNA

SEQ ID NO: 11729 - protein, 10 aa, Brucella spp.
AALANSGGTF

SEQ ID NO: 11730 - protein, 8 aa, Brucella spp.
DPERQHDF

SEQ ID NO: 11731 - protein, 11 aa, Brucella spp.
VAHENKKPKHS

SEQ ID NO: 11732 - protein, 10 aa, Brucella spp.
DKGATVGYGG

SEQ ID NO: 11733 - protein, 6 aa, Brucella spp.
SNKGAA

SEQ ID NO: 11734 - protein, 6 aa, Brucella spp.
SLPEGT

SEQ ID NO: 11735 - protein, 16 aa, Brucella spp.
SGAWTESTYRANEDDF

SEQ ID NO: 11736 - protein, 6 aa, Brucella spp.
PTGLTG

SEQ ID NO: 11737 - protein, 6 aa, Brucella spp.
AKAAGC

SEQ ID NO: 11738 - protein, 14 aa, Brucella spp.
KDIRNGLSAPPKFT

SEQ ID NO: 11739 - protein, 7 aa, Brucella spp.
AKNVTDL

SEQ ID NO: 11740 - protein, 9 aa, Brucella spp.
KMAAKSGAD

SEQ ID NO: 11741 - protein, 13 aa, Brucella spp.
HGGRQLDGAPSSI

SEQ ID NO: 11742 - protein, 7 aa, Brucella spp.
GIRSGQD

SEQ ID NO: 11743 - protein, 4 aa, Brucella spp.
GNEG

SEQ ID NO: 11744 - protein, 4 aa, Brucella spp.
DINE

SEQ ID NO: 11745 - protein, 10 aa, Brucella spp.
KRSSAAGGWG

SEQ ID NO: 11746 - protein, 8 aa, Brucella spp.
SGAPLAGA

SEQ ID NO: 11747 - protein, 8 aa, Brucella spp.
ANQPDGFD

SEQ ID NO: 11748 - protein, 8 aa, Brucella spp.
GDPEHGSS

SEQ ID NO: 11749 - protein, 8 aa, Brucella spp.
ATDRRTTP

SEQ ID NO: 11750 - protein, 7 aa, Brucella spp.
LENTGRL

SEQ ID NO: 11751 - protein, 7 aa, Brucella spp.
TATDKYE

SEQ ID NO: 11752 - protein, 5 aa, Brucella spp.
FDTPD

SEQ ID NO: 11753 - protein, 8 aa, Brucella spp.
SGRASNEA

SEQ ID NO: 11754 - protein, 6 aa, Brucella spp.
TNNFPD

SEQ ID NO: 11755 - protein, 7 aa, Brucella spp.
SVGVGKG

SEQ ID NO: 11756 - protein, 8 aa, Brucella spp.
QNPGTNHP

SEQ ID NO: 11757 - protein, 7 aa, Brucella spp.
RAAERGA

SEQ ID NO: 11758 - protein, 7 aa, Brucella spp.
FADPQDK

SEQ ID NO: 11759 - protein, 7 aa, Brucella spp.
GSEPITS

SEQ ID NO: 11760 - protein, 9 aa, Brucella spp.
ALAAGRPSV

SEQ ID NO: 11761 - protein, 13 aa, Brucella spp.
DATSWDEIEDQSG

SEQ ID NO: 11762 - protein, 7 aa, Brucella spp.
IGKPGAG

SEQ ID NO: 11763 - protein, 10 aa, Brucella spp.
HSNVQGDRTV

SEQ ID NO: 11764 - protein, 4 aa, Brucella spp.
INEH

SEQ ID NO: 11765 - protein, 8 aa, Brucella spp.
KPPREPGH

SEQ ID NO: 11766 - protein, 9 aa, Brucella spp.
ARATPDSPI

SEQ ID NO: 11767 - protein, 5 aa, Brucella spp.
LNSKG

SEQ ID NO: 11768 - protein, 11 aa, Brucella spp.
SGGINQPASPL

SEQ ID NO: 11769 - protein, 7 aa, Brucella spp.
ATLGPKP

SEQ ID NO: 11770 - protein, 8 aa, Brucella spp.
WNTPTGKA

SEQ ID NO: 11771 - protein, 8 aa, Brucella spp.
QVRDKPGR

SEQ ID NO: 11772 - protein, 6 aa, Brucella spp.
HDQYNT

SEQ ID NO: 11773 - protein, 8 aa, Brucella spp.
VEAGDRAD

SEQ ID NO: 11774 - protein, 14 aa, Brucella spp.
GSAGDESDTPTSKS

SEQ ID NO: 11775 - protein, 7 aa, Brucella spp.
GSPAYAD

SEQ ID NO: 11776 - protein, 5 aa, Brucella spp.
VEQRA

SEQ ID NO: 11777 - protein, 6 aa, Brucella spp.
SMDAAE

SEQ ID NO: 11778 - protein, 6 aa, Brucella spp.
ANFKRQ

SEQ ID NO: 11779 - protein, 36 aa, Brucella spp.
FTTRSQYDQADQALRTAQSALSSAQSQLGNARDELS

SEQ ID NO: 11780 - protein, 6 aa, Brucella spp.
NIETGQ

SEQ ID NO: 11781 - protein, 8 aa, Brucella spp.
AEDGSRDA

SEQ ID NO: 11782 - protein, 9 aa, Brucella spp.
PSIEAEGNI

SEQ ID NO: 11783 - protein, 7 aa, Brucella spp.
DAQTGTV

SEQ ID NO: 11784 - protein, 7 aa, Brucella spp.
ASEAGRT

SEQ ID NO: 11785 - protein, 6 aa, Brucella spp.
LRSGEP

SEQ ID NO: 11786 - protein, 8 aa, Brucella spp.
GREEDPEF

SEQ ID NO: 11787 - protein, 11 aa, Brucella spp.
WPGASIDETLN

SEQ ID NO: 11788 - protein, 8 aa, Brucella spp.
RSVTTAGK

SEQ ID NO: 11789 - protein, 10 aa, Brucella spp.
TTRAQDVKKS

SEQ ID NO: 11790 - protein, 6 aa, Brucella spp.
NTLPQG

SEQ ID NO: 11791 - protein, 4 aa, Brucella spp.
AEDV

SEQ ID NO: 11792 - protein, 10 aa, Brucella spp.
DQNAITPSGV

SEQ ID NO: 11793 - protein, 7 aa, Brucella spp.
VQAGPER

SEQ ID NO: 11794 - protein, 8 aa, Brucella spp.
GQFNSEAD

SEQ ID NO: 11795 - protein, 6 aa, Brucella spp.
VDPPTS

SEQ ID NO: 11796 - protein, 5 aa, Brucella spp.
KPNGN

SEQ ID NO: 11797 - protein, 6 aa, Brucella spp.
DQPQVV

SEQ ID NO: 11798 - protein, 8 aa, Brucella spp.
HGDPINKA

SEQ ID NO: 11799 - protein, 7 aa, Brucella spp.
NSQAGEY

SEQ ID NO: 11800 - protein, 9 aa, Brucella spp.
MKPHEEKRS

SEQ ID NO: 11801 - protein, 6 aa, Brucella spp.
QSDRPE

SEQ ID NO: 11802 - protein, 12 aa, Brucella spp.
QNSSIADTKAQM

SEQ ID NO: 11803 - protein, 6 aa, Brucella spp.
DNPDVE

SEQ ID NO: 11804 - protein, 5 aa, Brucella spp.
PANPY

SEQ ID NO: 11805 - protein, 5 aa, Brucella spp.
EARDR

SEQ ID NO: 11806 - protein, 7 aa, Brucella spp.
GPPVGRP

SEQ ID NO: 11807 - protein, 6 aa, Brucella spp.
SGPDVQ

SEQ ID NO: 11808 - protein, 4 aa, Brucella spp.
NEPG

SEQ ID NO: 11809 - protein, 13 aa, Brucella spp.
RKLGISSKDIATT

SEQ ID NO: 11810 - protein, 9 aa, Brucella spp.
QAHERDSID

SEQ ID NO: 11811 - protein, 9 aa, Brucella spp.
ATGNGTSVP

SEQ ID NO: 11812 - protein, 4 aa, Brucella spp.
MPDT

SEQ ID NO: 11813 - protein, 4 aa, Brucella spp.
LGPA

SEQ ID NO: 11814 - protein, 13 aa, Brucella spp.
GTVEESGKSQGPI

SEQ ID NO: 11815 - protein, 5 aa, Brucella spp.
PSGKP

SEQ ID NO: 11816 - protein, 13 aa, Brucella spp.
EPEHSPDEPHPAS

SEQ ID NO: 11817 - protein, 7 aa, Brucella spp.
TEQSPAV

SEQ ID NO: 11818 - protein, 6 aa, Brucella spp.
KEAGTF

SEQ ID NO: 11819 - protein, 5 aa, Brucella spp.
DPAVI

SEQ ID NO: 11820 - protein, 10 aa, Brucella spp.
TAARGSSDHA

SEQ ID NO: 11821 - protein, 5 aa, Brucella spp.
SIGPS

SEQ ID NO: 11822 - protein, 9 aa, Brucella spp.
SQSGASPDI

SEQ ID NO: 11823 - protein, 11 aa, Brucella spp.
QEAAKKGGATT

SEQ ID NO: 11824 - protein, 6 aa, Brucella spp.
SPLARD

SEQ ID NO: 11825 - protein, 10 aa, Brucella spp.
GEEKSVAATK

SEQ ID NO: 11826 - protein, 12 aa, Brucella spp.
AASSGDAGLRGG

SEQ ID NO: 11827 - protein, 9 aa, Brucella spp.
AATRPEGRE

SEQ ID NO: 11828 - protein, 7 aa, Brucella spp.
YTGGRGT

SEQ ID NO: 11829 - protein, 8 aa, Brucella spp.
KAKETANI

SEQ ID NO: 11830 - protein, 5 aa, Brucella spp.
DEAFD

SEQ ID NO: 11831 - protein, 4 aa, Brucella spp.
SHSF

SEQ ID NO: 11832 - protein, 7 aa, Brucella spp.
DAQTPGF

SEQ ID NO: 11833 - protein, 10 aa, Brucella spp.
PSASTGSPHL

SEQ ID NO: 11834 - protein, 20 aa, Brucella spp.
RRKGFDPDKPRNLNKVTVTV

SEQ ID NO: 11835 - protein, 7 aa, Brucella spp.
SLAEGHE

SEQ ID NO: 11836 - protein, 8 aa, Brucella spp.
VNGGGGRM

SEQ ID NO: 11837 - protein, 7 aa, Brucella spp.
NDEPTPE

SEQ ID NO: 11838 - protein, 7 aa, Brucella spp.
HRKYGTT

SEQ ID NO: 11839 - protein, 6 aa, Brucella spp.
KADRGV

SEQ ID NO: 11840 - protein, 8 aa, Brucella spp.
LAPARKGA

SEQ ID NO: 11841 - protein, 8 aa, Brucella spp.
EQVTPEQV

SEQ ID NO: 11842 - protein, 4 aa, Brucella spp.
RLSD

SEQ ID NO: 11843 - protein, 9 aa, Brucella spp.
HSDTTAEEA

SEQ ID NO: 11844 - protein, 5 aa, Brucella spp.
AGARS

SEQ ID NO: 11845 - protein, 8 aa, Brucella spp.
HRAPGLAG

SEQ ID NO: 11846 - protein, 5 aa, Brucella spp.
AKRGD

SEQ ID NO: 11847 - protein, 9 aa, Brucella spp.
SDAESFEIN

SEQ ID NO: 11848 - protein, 7 aa, Brucella spp.
SVRRVPG

SEQ ID NO: 11849 - protein, 9 aa, Brucella spp.
DGTIAGSDL

SEQ ID NO: 11850 - protein, 5 aa, Brucella spp.
RGRFR

SEQ ID NO: 11851 - protein, 5 aa, Brucella spp.
ARADR

SEQ ID NO: 11852 - protein, 9 aa, Brucella spp.
SGVNAAPIE

SEQ ID NO: 11853 - protein, 7 aa, Brucella spp.
RYAREKG

SEQ ID NO: 11854 - protein, 7 aa, Brucella spp.
NTIARGR

SEQ ID NO: 11855 - protein, 8 aa, Brucella spp.
NDAPSGDA

SEQ ID NO: 11856 - protein, 6 aa, Brucella spp.
KVGPVS

SEQ ID NO: 11857 - protein, 7 aa, Brucella spp.
VGEGDAP

SEQ ID NO: 11858 - protein, 8 aa, Brucella spp.
MPGSGDIN

SEQ ID NO: 11859 - protein, 4 aa, Brucella spp.
STRG

SEQ ID NO: 11860 - protein, 9 aa, Brucella spp.
KANKPEAER

SEQ ID NO: 11861 - protein, 4 aa, Brucella spp.
DTNT

SEQ ID NO: 11862 - protein, 11 aa, Brucella spp.
KGANPYKQAYE

SEQ ID NO: 11863 - protein, 5 aa, Brucella spp.
DEGPI

SEQ ID NO: 11864 - protein, 9 aa, Brucella spp.
THAQNSADY

SEQ ID NO: 11865 - protein, 12 aa, Brucella spp.
ASPGSFASERMG

SEQ ID NO: 11866 - protein, 14 aa, Brucella spp.
TAPAAPKTTALQGD

SEQ ID NO: 11867 - protein, 9 aa, Brucella spp.
GYGGSGRNV

SEQ ID NO: 11868 - protein, 4 aa, Brucella spp.
EKQG

SEQ ID NO: 11869 - protein, 11 aa, Brucella spp.
KGLKELEDRHE

SEQ ID NO: 11870 - protein, 7 aa, Brucella spp.
QWARRGA

SEQ ID NO: 11871 - protein, 15 aa, Brucella spp.
ARETEARVGTRAYTG

SEQ ID NO: 11872 - protein, 9 aa, Brucella spp.
IGAEEKNGK

SEQ ID NO: 11873 - protein, 6 aa, Brucella spp.
ARGSVT

SEQ ID NO: 11874 - protein, 6 aa, Brucella spp.
AYTNAP

SEQ ID NO: 11875 - protein, 7 aa, Brucella spp.
KPLSDNL

SEQ ID NO: 11876 - protein, 5 aa, Brucella spp.
ILPER

SEQ ID NO: 11877 - protein, 6 aa, Brucella spp.
LRNTGA

SEQ ID NO: 11878 - protein, 4 aa, Brucella spp.
TNDS

SEQ ID NO: 11879 - protein, 11 aa, Brucella spp.
GYNGRGIAPGT

SEQ ID NO: 11880 - protein, 6 aa, Brucella spp.
GEISEA

SEQ ID NO: 11881 - protein, 5 aa, Brucella spp.
EQNFR

SEQ ID NO: 11882 - protein, 4 aa, Brucella spp.
ARRT

SEQ ID NO: 11883 - protein, 10 aa, Brucella spp.
IGGQGKLTPE

SEQ ID NO: 11884 - protein, 6 aa, Brucella spp.
VETKAE

SEQ ID NO: 11885 - protein, 13 aa, Brucella spp.
KPKRRTRAEIARE

SEQ ID NO: 11886 - protein, 4 aa, Brucella spp.
TPEV

SEQ ID NO: 11887 - protein, 7 aa, Brucella spp.
AALDGAR

SEQ ID NO: 11888 - protein, 4 aa, Brucella spp.
AVQH

SEQ ID NO: 11889 - protein, 10 aa, Brucella spp.
DGKQEAGAKF

SEQ ID NO: 11890 - protein, 11 aa, Brucella spp.
DADDTSPIKPV

SEQ ID NO: 11891 - protein, 6 aa, Brucella spp.
ERAEEE

SEQ ID NO: 11892 - protein, 10 aa, Brucella spp.
APAGSRATMG

SEQ ID NO: 11893 - protein, 5 aa, Brucella spp.
PGIRT

SEQ ID NO: 11894 - protein, 6 aa, Brucella spp.
DGTGKL

SEQ ID NO: 11895 - protein, 14 aa, Brucella spp.
PFPPKNDVRGTQAE

SEQ ID NO: 11896 - protein, 9 aa, Brucella spp.
NGTGSRETE

SEQ ID NO: 11897 - protein, 6 aa, Brucella spp.
MPAPKP

SEQ ID NO: 11898 - protein, 16 aa, Brucella spp.
AGASVYSASETAAAEF

SEQ ID NO: 11899 - protein, 7 aa, Brucella spp.
PKSIGVG

SEQ ID NO: 11900 - protein, 5 aa, Brucella spp.
NTASA

SEQ ID NO: 11901 - protein, 4 aa, Brucella spp.
LGAS

SEQ ID NO: 11902 - protein, 9 aa, Brucella spp.
DAAGAFKNR

SEQ ID NO: 11903 - protein, 10 aa, Brucella spp.
NGDEPLDASA

SEQ ID NO: 11904 - protein, 4 aa, Brucella spp.
HPEA

SEQ ID NO: 11905 - protein, 6 aa, Brucella spp.
AALKSL

SEQ ID NO: 11906 - protein, 12 aa, Brucella spp.
DKPGRDPRPEFK

SEQ ID NO: 11907 - protein, 37 aa, Brucella spp.
KDGGEAPAPRAPGARDQRPAKNFSPQRRQEQPSTGAF

SEQ ID NO: 11908 - protein, 9 aa, Brucella spp.
RNRSPHAVP

SEQ ID NO: 11909 - protein, 13 aa, Brucella spp.
TPISQQGQGYADV

SEQ ID NO: 11910 - protein, 7 aa, Brucella spp.
VHNAGGK

SEQ ID NO: 11911 - protein, 21 aa, Brucella spp.
NSLQPNGEKPVAPSAITAKSK

SEQ ID NO: 11912 - protein, 22 aa, Brucella spp.
DGAGEFVPTSEPRALEKSELPG

SEQ ID NO: 11913 - protein, 13 aa, Brucella spp.
ARAAKDAVETAGF

SEQ ID NO: 11914 - protein, 16 aa, Brucella spp.
GGSNQRTDEYGGSIEN

SEQ ID NO: 11915 - protein, 7 aa, Brucella spp.
KAIGAGK

SEQ ID NO: 11916 - protein, 15 aa, Brucella spp.
PVTPANDASDPDPQP

SEQ ID NO: 11917 - protein, 15 aa, Brucella spp.
ATGGPRDFQQGPQPF

SEQ ID NO: 11918 - protein, 7 aa, Brucella spp.
RDAGGKA

SEQ ID NO: 11919 - protein, 15 aa, Brucella spp.
YDRKMAEEEVEAGRA

SEQ ID NO: 11920 - protein, 7 aa, Brucella spp.
ENAPLNE

SEQ ID NO: 11921 - protein, 16 aa, Brucella spp.
MYGGGAKGYTDYPVLA

SEQ ID NO: 11922 - protein, 19 aa, Brucella spp.
EGTGRKGCNMGPDSYRAAG

SEQ ID NO: 11923 - protein, 12 aa, Brucella spp.
LAPAAQRPLQHP

SEQ ID NO: 11924 - protein, 8 aa, Brucella spp.
AAYRESAE

SEQ ID NO: 11925 - protein, 6 aa, Brucella spp.
TVPGIA

SEQ ID NO: 11926 - protein, 9 aa, Brucella spp.
RRAAEKGRK

SEQ ID NO: 11927 - protein, 11 aa, Brucella spp.
ETTTSGNLHGT

SEQ ID NO: 11928 - protein, 8 aa, Brucella spp.
TGQKGFEG

SEQ ID NO: 11929 - protein, 4 aa, Brucella spp.
APID

SEQ ID NO: 11930 - protein, 11 aa, Brucella spp.
VDPAEREAVKK

SEQ ID NO: 11931 - protein, 15 aa, Brucella spp.
IAPAVGTTVPGGATF

SEQ ID NO: 11932 - protein, 6 aa, Brucella spp.
ERGRTA

SEQ ID NO: 11933 - protein, 13 aa, Brucella spp.
DKTPRVASHSKEG

SEQ ID NO: 11934 - protein, 6 aa, Brucella spp.
TSDGTL

SEQ ID NO: 11935 - protein, 11 aa, Brucella spp.
GHPKNTRDGLQ

SEQ ID NO: 11936 - protein, 7 aa, Brucella spp.
TAATSAV

SEQ ID NO: 11937 - protein, 7 aa, Brucella spp.
LAPKNAR

SEQ ID NO: 11938 - protein, 7 aa, Brucella spp.
NSAQSEF

SEQ ID NO: 11939 - protein, 6 aa, Brucella spp.
DPQATA

SEQ ID NO: 11940 - protein, 6 aa, Brucella spp.
EEAVEG

SEQ ID NO: 11941 - protein, 9 aa, Brucella spp.
TADKANATI

SEQ ID NO: 11942 - protein, 10 aa, Brucella spp.
GGDCPGKTEL

SEQ ID NO: 11943 - protein, 7 aa, Brucella spp.
PPQTRIE

SEQ ID NO: 11944 - protein, 5 aa, Brucella spp.
LPEDY

SEQ ID NO: 11945 - protein, 9 aa, Brucella spp.
IAGRKDARQ

SEQ ID NO: 11946 - protein, 5 aa, Brucella spp.
KDTGL

SEQ ID NO: 11947 - protein, 8 aa, Brucella spp.
ADPDEPRD

SEQ ID NO: 11948 - protein, 13 aa, Brucella spp.
SQNLRGEIPGGHT

SEQ ID NO: 11949 - protein, 7 aa, Brucella spp.
VSFGKPE

SEQ ID NO: 11950 - protein, 6 aa, Brucella spp.
ANDTNH

SEQ ID NO: 11951 - protein, 11 aa, Brucella spp.
PLTNEATTSIR

SEQ ID NO: 11952 - protein, 5 aa, Brucella spp.
TGHEP

SEQ ID NO: 11953 - protein, 14 aa, Brucella spp.
IDSETDDTDEPVDA

SEQ ID NO: 11954 - protein, 7 aa, Brucella spp.
ESLRPEL

SEQ ID NO: 11955 - protein, 11 aa, Brucella spp.
EQAQDAGDIDR

SEQ ID NO: 11956 - protein, 7 aa, Brucella spp.
ARAGNET

SEQ ID NO: 11957 - protein, 7 aa, Brucella spp.
FGPAEKQ

SEQ ID NO: 11958 - protein, 7 aa, Brucella spp.
PDLKTRA

SEQ ID NO: 11959 - protein, 7 aa, Brucella spp.
DGIGPEA

SEQ ID NO: 11960 - protein, 5 aa, Brucella spp.
ETEEG

SEQ ID NO: 11961 - protein, 10 aa, Brucella spp.
HGQAISDADM

SEQ ID NO: 11962 - protein, 6 aa, Brucella spp.
GGPKWD

SEQ ID NO: 11963 - protein, 6 aa, Brucella spp.
EVRPEG

SEQ ID NO: 11964 - protein, 8 aa, Brucella spp.
SSSLKPEV

SEQ ID NO: 11965 - protein, 10 aa, Brucella spp.
GNGQKRGIDT

SEQ ID NO: 11966 - protein, 11 aa, Brucella spp.
TRRNKVTSMEK

SEQ ID NO: 11967 - protein, 10 aa, Brucella spp.
TARHKEKHAD

SEQ ID NO: 11968 - protein, 15 aa, Brucella spp.
ASLGAADSKTGKRKA

SEQ ID NO: 11969 - protein, 12 aa, Brucella spp.
GSAPDIAGKGIA

SEQ ID NO: 11970 - protein, 13 aa, Brucella spp.
SEGNTKVGTTEMG

SEQ ID NO: 11971 - protein, 7 aa, Brucella spp.
QKMTGEE

SEQ ID NO: 11972 - protein, 5 aa, Brucella spp.
YPEAT

SEQ ID NO: 11973 - protein, 4 aa, Brucella spp.
GSAS

SEQ ID NO: 11974 - protein, 8 aa, Brucella spp.
GGEYGGAA

SEQ ID NO: 11975 - protein, 7 aa, Brucella spp.
HAPNNRR

SEQ ID NO: 11976 - protein, 5 aa, Brucella spp.
ESPAF

SEQ ID NO: 11977 - protein, 14 aa, Brucella spp.
KEEGKTSKAPLSEA

SEQ ID NO: 11978 - protein, 5 aa, Brucella spp.
ENQSA

SEQ ID NO: 11979 - protein, 4 aa, Brucella spp.
IGRK

SEQ ID NO: 11980 - protein, 14 aa, Brucella spp.
NAANPALAQAEQTV

SEQ ID NO: 11981 - protein, 10 aa, Brucella spp.
ATGTSKFTTS

SEQ ID NO: 11982 - protein, 8 aa, Brucella spp.
SSVPYETV

SEQ ID NO: 11983 - protein, 11 aa, Brucella spp.
QTAAPGTPATI

SEQ ID NO: 11984 - protein, 5 aa, Brucella spp.
TTIQS

SEQ ID NO: 11985 - protein, 14 aa, Brucella spp.
VQAGADAAAKQAAL

SEQ ID NO: 11986 - protein, 7 aa, Brucella spp.
AKVPDSK

SEQ ID NO: 11987 - protein, 4 aa, Brucella spp.
PELQ

SEQ ID NO: 11988 - protein, 10 aa, Brucella spp.
AIRAGDAKTM

SEQ ID NO: 11989 - protein, 15 aa, Brucella spp.
TQSEAESLGVSSEQA

SEQ ID NO: 11990 - protein, 5 aa, Brucella spp.
AAKGD

SEQ ID NO: 11991 - protein, 4 aa, Brucella spp.
GNVG

SEQ ID NO: 11992 - protein, 4 aa, Brucella spp.
GFPA

SEQ ID NO: 11993 - protein, 15 aa, Brucella spp.
SRRSQGTEVSYGDKT

SEQ ID NO: 11994 - protein, 14 aa, Brucella spp.
GGSVSQEWSPKIGR

SEQ ID NO: 11995 - protein, 4 aa, Brucella spp.
SAWR

SEQ ID NO: 11996 - protein, 6 aa, Brucella spp.
PDAIAG

SEQ ID NO: 11997 - protein, 7 aa, Brucella spp.
ANPNCST

SEQ ID NO: 11998 - protein, 11 aa, Brucella spp.
QSVSGAGKEGM

SEQ ID NO: 11999 - protein, 6 aa, Brucella spp.
ISTKKF

SEQ ID NO: 12000 - protein, 5 aa, Brucella spp.
GYTKE

SEQ ID NO: 12001 - protein, 7 aa, Brucella spp.
PITPEEA

SEQ ID NO: 12002 - protein, 18 aa, Brucella spp.
HENGGYITPYESAGEDAT

SEQ ID NO: 12003 - protein, 6 aa, Brucella spp.
LRKGAA

SEQ ID NO: 12004 - protein, 14 aa, Brucella spp.
TGGRTGSAKTADGR

SEQ ID NO: 12005 - protein, 17 aa, Brucella spp.
TPKELGGQGGEGTNPEQ

SEQ ID NO: 12006 - protein, 12 aa, Brucella spp.
KISIPAESTVTA

SEQ ID NO: 12007 - protein, 11 aa, Brucella spp.
GIGPREDGTGF

SEQ ID NO: 12008 - protein, 9 aa, Brucella spp.
IDKAKAEEL

SEQ ID NO: 12009 - protein, 13 aa, Brucella spp.
ATRGNLDVRLSVA

SEQ ID NO: 12010 - protein, 6 aa, Brucella spp.
KRTGLG

SEQ ID NO: 12011 - protein, 8 aa, Brucella spp.
EDGSENPD

SEQ ID NO: 12012 - protein, 6 aa, Brucella spp.
KPGYRK

SEQ ID NO: 12013 - protein, 10 aa, Brucella spp.
FGCGSSREHA

SEQ ID NO: 12014 - protein, 10 aa, Brucella spp.
DDASRGANAT

SEQ ID NO: 12015 - protein, 10 aa, Brucella spp.
QIHGPDGGTI

SEQ ID NO: 12016 - protein, 17 aa, Brucella spp.
KSIDTFEAKNAEERPWA

SEQ ID NO: 12017 - protein, 4 aa, Brucella spp.
GKTT

SEQ ID NO: 12018 - protein, 10 aa, Brucella spp.
QSGSFRENQR

SEQ ID NO: 12019 - protein, 8 aa, Brucella spp.
NDIEKERG

SEQ ID NO: 12020 - protein, 10 aa, Brucella spp.
TPGHADFGGE

SEQ ID NO: 12021 - protein, 6 aa, Brucella spp.
EGPMPQ

SEQ ID NO: 12022 - protein, 9 aa, Brucella spp.
DRPDGRHEE

SEQ ID NO: 12023 - protein, 6 aa, Brucella spp.
DATDEQ

SEQ ID NO: 12024 - protein, 10 aa, Brucella spp.
SPEGPKDQGL

SEQ ID NO: 12025 - protein, 9 aa, Brucella spp.
PAPKVAEGP

SEQ ID NO: 12026 - protein, 8 aa, Brucella spp.
GSIKPNQA

SEQ ID NO: 12027 - protein, 10 aa, Brucella spp.
GQDGSVLENG

SEQ ID NO: 12028 - protein, 5 aa, Brucella spp.
DEAHA

SEQ ID NO: 12029 - protein, 6 aa, Brucella spp.
SKGTVA

SEQ ID NO: 12030 - protein, 15 aa, Brucella spp.
SVSEPLAAQPIDPPT

SEQ ID NO: 12031 - protein, 14 aa, Brucella spp.
SPYAGTEGDKVTSR

SEQ ID NO: 12032 - protein, 5 aa, Brucella spp.
EAEGN

SEQ ID NO: 12033 - protein, 7 aa, Brucella spp.
EESTEKD

SEQ ID NO: 12034 - protein, 10 aa, Brucella spp.
DGENGEKLEP

SEQ ID NO: 12035 - protein, 6 aa, Brucella spp.
EEYSGT

SEQ ID NO: 12036 - protein, 6 aa, Brucella spp.
MSERKA

SEQ ID NO: 12037 - protein, 7 aa, Brucella spp.
RPSGGNR

SEQ ID NO: 12038 - protein, 7 aa, Brucella spp.
TDTRGTA

SEQ ID NO: 12039 - protein, 11 aa, Brucella spp.
PYKGEIAGRNN

SEQ ID NO: 12040 - protein, 7 aa, Brucella spp.
NDQGEAV

SEQ ID NO: 12041 - protein, 5 aa, Brucella spp.
RDNDL

SEQ ID NO: 12042 - protein, 19 aa, Brucella spp.
KLTNIRAAGKDEAVKLTPP

SEQ ID NO: 12043 - protein, 17 aa, Brucella spp.
DPNERKRFEKSKSSSAA

SEQ ID NO: 12044 - protein, 4 aa, Brucella spp.
FSQE

SEQ ID NO: 12045 - protein, 8 aa, Brucella spp.
VASEEAAK

SEQ ID NO: 12046 - protein, 15 aa, Brucella spp.
FSDDGEPSGTAGKPI

SEQ ID NO: 12047 - protein, 6 aa, Brucella spp.
YGGTAA

SEQ ID NO: 12048 - protein, 6 aa, Brucella spp.
QAEKTE

SEQ ID NO: 12049 - protein, 4 aa, Brucella spp.
DDLS

SEQ ID NO: 12050 - protein, 12 aa, Brucella spp.
LTRGKTIITFDE

SEQ ID NO: 12051 - protein, 9 aa, Brucella spp.
SDRVEAETV

SEQ ID NO: 12052 - protein, 9 aa, Brucella spp.
YLPGDPGKL

SEQ ID NO: 12053 - protein, 14 aa, Brucella spp.
VNSDQDQQKSIDVG

SEQ ID NO: 12054 - protein, 11 aa, Brucella spp.
ADLPVAGKADG

SEQ ID NO: 12055 - protein, 13 aa, Brucella spp.
PLDGSGNVGLGAP

SEQ ID NO: 12056 - protein, 6 aa, Brucella spp.
PGNRQI

SEQ ID NO: 12057 - protein, 8 aa, Brucella spp.
KLPERTSD

SEQ ID NO: 12058 - protein, 9 aa, Brucella spp.
GKDGPRGRN

SEQ ID NO: 12059 - protein, 8 aa, Brucella spp.
SRPGYEKG

SEQ ID NO: 12060 - protein, 12 aa, Brucella spp.
EAGGKATDGSRP

SEQ ID NO: 12061 - protein, 7 aa, Brucella spp.
AEKGYGV

SEQ ID NO: 12062 - protein, 8 aa, Brucella spp.
SRGARSYA

SEQ ID NO: 12063 - protein, 5 aa, Brucella spp.
GNEAA

SEQ ID NO: 12064 - protein, 11 aa, Brucella spp.
LKADGKTPADW

SEQ ID NO: 12065 - protein, 17 aa, Brucella spp.
TGMGDVEDAHGAEGKLS

SEQ ID NO: 12066 - protein, 6 aa, Brucella spp.
TDPDEA

SEQ ID NO: 12067 - protein, 5 aa, Brucella spp.
TSHGA

SEQ ID NO: 12068 - protein, 7 aa, Brucella spp.
SRKPDGS

SEQ ID NO: 12069 - protein, 7 aa, Brucella spp.
SSSVPEE

SEQ ID NO: 12070 - protein, 7 aa, Brucella spp.
GGQMKPT

SEQ ID NO: 12071 - protein, 5 aa, Brucella spp.
IDTDN

SEQ ID NO: 12072 - protein, 9 aa, Brucella spp.
EEPSEFDPR

SEQ ID NO: 12073 - protein, 6 aa, Brucella spp.
GTAGHA

SEQ ID NO: 12074 - protein, 12 aa, Brucella spp.
RYRDGSLDPKFS

SEQ ID NO: 12075 - protein, 10 aa, Brucella spp.
ISRTDAGADA

SEQ ID NO: 12076 - protein, 4 aa, Brucella spp.
DGTY

SEQ ID NO: 12077 - protein, 5 aa, Brucella spp.
KVPGI

SEQ ID NO: 12078 - protein, 14 aa, Brucella spp.
HDTYSAERAALSNN

SEQ ID NO: 12079 - protein, 12 aa, Brucella spp.
FDENGRSAGNVN

SEQ ID NO: 12080 - protein, 4 aa, Brucella spp.
ADGA

SEQ ID NO: 12081 - protein, 7 aa, Brucella spp.
PDIGEEG

SEQ ID NO: 12082 - protein, 4 aa, Brucella spp.
KTGM

SEQ ID NO: 12083 - protein, 5 aa, Brucella spp.
TAEDR

SEQ ID NO: 12084 - protein, 5 aa, Brucella spp.
TGRTI

SEQ ID NO: 12085 - protein, 6 aa, Brucella spp.
SVENAD

SEQ ID NO: 12086 - protein, 15 aa, Brucella spp.
DERTAKALIGQPNGK

SEQ ID NO: 12087 - protein, 14 aa, Brucella spp.
INGAGVARDAAGRG

SEQ ID NO: 12088 - protein, 15 aa, Brucella spp.
KDDLAQGTSSRSGKL

SEQ ID NO: 12089 - protein, 7 aa, Brucella spp.
HSPQDRP

SEQ ID NO: 12090 - protein, 10 aa, Brucella spp.
GRKKLPGTRT

SEQ ID NO: 12091 - protein, 9 aa, Brucella spp.
KRDPEGTPI

SEQ ID NO: 12092 - protein, 9 aa, Brucella spp.
GAAEKGATI

SEQ ID NO: 12093 - protein, 8 aa, Brucella spp.
SARRENGG

SEQ ID NO: 12094 - protein, 10 aa, Brucella spp.
RNSDTGETHT

SEQ ID NO: 12095 - protein, 9 aa, Brucella spp.
AASTSSRNV

SEQ ID NO: 12096 - protein, 6 aa, Brucella spp.
KALIGT

SEQ ID NO: 12097 - protein, 15 aa, Brucella spp.
AYEGRAEDVAADEKE

SEQ ID NO: 12098 - protein, 11 aa, Brucella spp.
DDGKGNPSAVT

SEQ ID NO: 12099 - protein, 6 aa, Brucella spp.
ETGGAP

SEQ ID NO: 12100 - protein, 14 aa, Brucella spp.
DAPLPGGEIANADY

SEQ ID NO: 12101 - protein, 15 aa, Brucella spp.
ARTKDVVAGAQNLEG

SEQ ID NO: 12102 - protein, 6 aa, Brucella spp.
RQIESA

SEQ ID NO: 12103 - protein, 9 aa, Brucella spp.
TGDHGAVTQ

SEQ ID NO: 12104 - protein, 7 aa, Brucella spp.
LPGLAQR

SEQ ID NO: 12105 - protein, 8 aa, Brucella spp.
VTGQGDGT

SEQ ID NO: 12106 - protein, 6 aa, Brucella spp.
DNRPVG

SEQ ID NO: 12107 - protein, 6 aa, Brucella spp.
AASTVT

SEQ ID NO: 12108 - protein, 5 aa, Brucella spp.
AGPMN

SEQ ID NO: 12109 - protein, 14 aa, Brucella spp.
EATGTGLNTCQQGA

SEQ ID NO: 12110 - protein, 9 aa, Brucella spp.
RATDPSEAS

SEQ ID NO: 12111 - protein, 17 aa, Brucella spp.
GSQSQHPLSAEAAAATG

SEQ ID NO: 12112 - protein, 15 aa, Brucella spp.
CGGTAGAGCSTIGST

SEQ ID NO: 12113 - protein, 5 aa, Brucella spp.
KEGTG

SEQ ID NO: 12114 - protein, 9 aa, Brucella spp.
MSTPEKPVS

SEQ ID NO: 12115 - protein, 5 aa, Brucella spp.
ASRPG

SEQ ID NO: 12116 - protein, 8 aa, Brucella spp.
EAGERGPF

SEQ ID NO: 12117 - protein, 4 aa, Brucella spp.
RDRF

SEQ ID NO: 12118 - protein, 14 aa, Brucella spp.
TGGAARSKALRGTL

SEQ ID NO: 12119 - protein, 11 aa, Brucella spp.
SAREEAGAAGA

SEQ ID NO: 12120 - protein, 12 aa, Brucella spp.
ASEAPDAARAHQ

SEQ ID NO: 12121 - protein, 8 aa, Brucella spp.
PTTRPSRA

SEQ ID NO: 12122 - protein, 8 aa, Brucella spp.
IGSDADVR

SEQ ID NO: 12123 - protein, 11 aa, Brucella spp.
PAAYGASEFPK

SEQ ID NO: 12124 - protein, 5 aa, Brucella spp.
SIEQR

SEQ ID NO: 12125 - protein, 15 aa, Brucella spp.
AADKAAAGKKYGVGS

SEQ ID NO: 12126 - protein, 10 aa, Brucella spp.
GTVEERKANY

SEQ ID NO: 12127 - protein, 16 aa, Brucella spp.
TGPAVNGTELRDATGE

SEQ ID NO: 12128 - protein, 12 aa, Brucella spp.
EYQNAGAALNNE

SEQ ID NO: 12129 - protein, 6 aa, Brucella spp.
NLNGKT

SEQ ID NO: 12130 - protein, 5 aa, Brucella spp.
VAKSY

SEQ ID NO: 12131 - protein, 9 aa, Brucella spp.
GENGAGKST

SEQ ID NO: 12132 - protein, 13 aa, Brucella spp.
PVTFNSSTEARDH

SEQ ID NO: 12133 - protein, 5 aa, Brucella spp.
RTATG

SEQ ID NO: 12134 - protein, 5 aa, Brucella spp.
EEERL

SEQ ID NO: 12135 - protein, 6 aa, Brucella spp.
IDPLTP

SEQ ID NO: 12136 - protein, 8 aa, Brucella spp.
PTSALSAS

SEQ ID NO: 12137 - protein, 4 aa, Brucella spp.
APRE

SEQ ID NO: 12138 - protein, 9 aa, Brucella spp.
LGSPPTGYE

SEQ ID NO: 12139 - protein, 10 aa, Brucella spp.
TVPDPSGSGF

SEQ ID NO: 12140 - protein, 4 aa, Brucella spp.
GRTE

SEQ ID NO: 12141 - protein, 8 aa, Brucella spp.
RLKSRGGR

SEQ ID NO: 12142 - protein, 4 aa, Brucella spp.
DISG

SEQ ID NO: 12143 - protein, 7 aa, Brucella spp.
EDRQRDG

SEQ ID NO: 12144 - protein, 8 aa, Brucella spp.
SRKREKRI

SEQ ID NO: 12145 - protein, 19 aa, Brucella spp.
KTDGGEAAIGSLSGGNQQK

SEQ ID NO: 12146 - protein, 7 aa, Brucella spp.
PSRGIDI

SEQ ID NO: 12147 - protein, 5 aa, Brucella spp.
KAKQG

SEQ ID NO: 12148 - protein, 23 aa, Brucella spp.
AEFGSDVSKEKIMTASGEAMVGH

SEQ ID NO: 12149 - protein, 10 aa, Brucella spp.
APTGAKRKTS

SEQ ID NO: 12150 - protein, 12 aa, Brucella spp.
NNLGGRPELGNT

SEQ ID NO: 12151 - protein, 13 aa, Brucella spp.
SGGNERAAELSGV

SEQ ID NO: 12152 - protein, 12 aa, Brucella spp.
LTSAGPTAGTTY

SEQ ID NO: 12153 - protein, 11 aa, Brucella spp.
ALTGGRGTIQG

SEQ ID NO: 12154 - protein, 5 aa, Brucella spp.
AEGLG

SEQ ID NO: 12155 - protein, 12 aa, Brucella spp.
GGHKGDTNTESN

SEQ ID NO: 12156 - protein, 9 aa, Brucella spp.
ANADGSVGA

SEQ ID NO: 12157 - protein, 5 aa, Brucella spp.
NQEGL

SEQ ID NO: 12158 - protein, 11 aa, Brucella spp.
VSNNAQGAALG

SEQ ID NO: 12159 - protein, 6 aa, Brucella spp.
VGDKGK

SEQ ID NO: 12160 - protein, 15 aa, Brucella spp.
APSDNNAATRSNGYE

SEQ ID NO: 12161 - protein, 10 aa, Brucella spp.
NWDRTQGHDK

SEQ ID NO: 12162 - protein, 5 aa, Brucella spp.
GNDEM

SEQ ID NO: 12163 - protein, 8 aa, Brucella spp.
KKAGKLDQ

SEQ ID NO: 12164 - protein, 10 aa, Brucella spp.
GGFDGSPDAI

SEQ ID NO: 12165 - protein, 4 aa, Brucella spp.
VKQA

SEQ ID NO: 12166 - protein, 10 aa, Brucella spp.
KTGKTGVDHE

SEQ ID NO: 12167 - protein, 13 aa, Brucella spp.
NVDKYNSPFVLEQ

SEQ ID NO: 12168 - protein, 7 aa, Brucella spp.
GKDAKLA

SEQ ID NO: 12169 - protein, 9 aa, Brucella spp.
ESDDATNTL

SEQ ID NO: 12170 - protein, 9 aa, Brucella spp.
ENGNENGAK

SEQ ID NO: 12171 - protein, 8 aa, Brucella spp.
AEAEAQEH

SEQ ID NO: 12172 - protein, 5 aa, Brucella spp.
TPDDI

SEQ ID NO: 12173 - protein, 15 aa, Brucella spp.
KEATELQEAQGNQAA

SEQ ID NO: 12174 - protein, 8 aa, Brucella spp.
KPNDRNAP

SEQ ID NO: 12175 - protein, 7 aa, Brucella spp.
RSAIPED

SEQ ID NO: 12176 - protein, 7 aa, Brucella spp.
AENAANQ

SEQ ID NO: 12177 - protein, 4 aa, Brucella spp.
HQLG

SEQ ID NO: 12178 - protein, 15 aa, Brucella spp.
GLGSDSLKDRLDRDD

SEQ ID NO: 12179 - protein, 8 aa, Brucella spp.
AVRSSNPV

SEQ ID NO: 12180 - protein, 8 aa, Brucella spp.
GGVPEPGS

SEQ ID NO: 12181 - protein, 17 aa, Brucella spp.
HYAKDEDGKNRCRTGAA

SEQ ID NO: 12182 - protein, 8 aa, Brucella spp.
ESEKHTSA

SEQ ID NO: 12183 - protein, 12 aa, Brucella spp.
GVPGQRKRRTQL

SEQ ID NO: 12184 - protein, 5 aa, Brucella spp.
GIADE

SEQ ID NO: 12185 - protein, 8 aa, Brucella spp.
KEQLEGER

SEQ ID NO: 12186 - protein, 10 aa, Brucella spp.
EQSPSPKKLM

SEQ ID NO: 12187 - protein, 6 aa, Brucella spp.
SINDHP

SEQ ID NO: 12188 - protein, 16 aa, Brucella spp.
HKSEGGGFGDGDNGDA

SEQ ID NO: 12189 - protein, 4 aa, Brucella spp.
HESM

SEQ ID NO: 12190 - protein, 10 aa, Brucella spp.
DAKQVQEDRT

SEQ ID NO: 12191 - protein, 8 aa, Brucella spp.
SKPGPSLR

SEQ ID NO: 12192 - protein, 8 aa, Brucella spp.
DSSPYGTD

SEQ ID NO: 12193 - protein, 10 aa, Brucella spp.
ISNRNHASAD

SEQ ID NO: 12194 - protein, 8 aa, Brucella spp.
VHSENTRQ

SEQ ID NO: 12195 - protein, 7 aa, Brucella spp.
NSEEINN

SEQ ID NO: 12196 - protein, 12 aa, Brucella spp.
FDPYSNGGVNRR

SEQ ID NO: 12197 - protein, 5 aa, Brucella spp.
PLTEQ

SEQ ID NO: 12198 - protein, 6 aa, Brucella spp.
AAIAKT

SEQ ID NO: 12199 - protein, 5 aa, Brucella spp.
EQTKK

SEQ ID NO: 12200 - protein, 14 aa, Brucella spp.
SGGTPATAAEENWK

SEQ ID NO: 12201 - protein, 9 aa, Brucella spp.
IKGPSISST

SEQ ID NO: 12202 - protein, 7 aa, Brucella spp.
ISEDAAK

SEQ ID NO: 12203 - protein, 6 aa, Brucella spp.
PNEGVA

SEQ ID NO: 12204 - protein, 9 aa, Brucella spp.
ETATHGTKR

SEQ ID NO: 12205 - protein, 14 aa, Brucella spp.
ESSQERLRSERDNL

SEQ ID NO: 12206 - protein, 7 aa, Brucella spp.
GSIDSSD

SEQ ID NO: 12207 - protein, 17 aa, Brucella spp.
RFEEEAKESIRQGLPEN

SEQ ID NO: 12208 - protein, 8 aa, Brucella spp.
VAYSDPDE

SEQ ID NO: 12209 - protein, 6 aa, Brucella spp.
LTTGIG

SEQ ID NO: 12210 - protein, 8 aa, Brucella spp.
EDANPSIE

SEQ ID NO: 12211 - protein, 14 aa, Brucella spp.
SESRLGDAKNREGV

SEQ ID NO: 12212 - protein, 8 aa, Brucella spp.
NASLSEPD

SEQ ID NO: 12213 - protein, 12 aa, Brucella spp.
ADDAGKKGGEFY

SEQ ID NO: 12214 - protein, 7 aa, Brucella spp.
PKPGMRI

SEQ ID NO: 12215 - protein, 8 aa, Brucella spp.
SDPTCGSG

SEQ ID NO: 12216 - protein, 5 aa, Brucella spp.
GKRLG

SEQ ID NO: 12217 - protein, 6 aa, Brucella spp.
QEKNLG

SEQ ID NO: 12218 - protein, 12 aa, Brucella spp.
ARIEKGDTIRNP

SEQ ID NO: 12219 - protein, 4 aa, Brucella spp.
NPPF

SEQ ID NO: 12220 - protein, 15 aa, Brucella spp.
GAEDVSGDTEKKGHN

SEQ ID NO: 12221 - protein, 4 aa, Brucella spp.
PKNM

SEQ ID NO: 12222 - protein, 9 aa, Brucella spp.
GSGDGRIRE

SEQ ID NO: 12223 - protein, 8 aa, Brucella spp.
AKATERKG

SEQ ID NO: 12224 - protein, 13 aa, Brucella spp.
EFEERPKKNILGE

SEQ ID NO: 12225 - protein, 4 aa, Brucella spp.
IEEN

SEQ ID NO: 12226 - protein, 9 aa, Brucella spp.
LEPEKPIDV

SEQ ID NO: 12227 - protein, 11 aa, Brucella spp.
AETARDEAAAR

SEQ ID NO: 12228 - protein, 11 aa, Brucella spp.
VSREETVIRPG

SEQ ID NO: 12229 - protein, 5 aa, Brucella spp.
APREA

SEQ ID NO: 12230 - protein, 8 aa, Brucella spp.
DETAGAVA

SEQ ID NO: 12231 - protein, 8 aa, Brucella spp.
PAPDATGG

SEQ ID NO: 12232 - protein, 4 aa, Brucella spp.
PKDL

SEQ ID NO: 12233 - protein, 5 aa, Brucella spp.
LNEQE

SEQ ID NO: 12234 - protein, 17 aa, Brucella spp.
NNDQIDRAAKMLKAFAG

SEQ ID NO: 12235 - protein, 8 aa, Brucella spp.
NARPEAQL

SEQ ID NO: 12236 - protein, 10 aa, Brucella spp.
AVNPGRPAAP

SEQ ID NO: 12237 - protein, 5 aa, Brucella spp.
NKRLE

SEQ ID NO: 12238 - protein, 4 aa, Brucella spp.
AVPE

SEQ ID NO: 12239 - protein, 12 aa, Brucella spp.
RHANSAIRKGAD

SEQ ID NO: 12240 - protein, 9 aa, Brucella spp.
GAGGHAGSL

SEQ ID NO: 12241 - protein, 4 aa, Brucella spp.
ANGR

SEQ ID NO: 12242 - protein, 7 aa, Brucella spp.
TEARAVD

SEQ ID NO: 12243 - protein, 6 aa, Brucella spp.
SDSSDI

SEQ ID NO: 12244 - protein, 20 aa, Brucella spp.
IAKAGLDPDNLPQADPSKMD

SEQ ID NO: 12245 - protein, 9 aa, Brucella spp.
KAQQEGAKA

SEQ ID NO: 12246 - protein, 6 aa, Brucella spp.
IAPTAS

SEQ ID NO: 12247 - protein, 14 aa, Brucella spp.
REYRDARAKLCAGA

SEQ ID NO: 12248 - protein, 7 aa, Brucella spp.
AADGEKP

SEQ ID NO: 12249 - protein, 11 aa, Brucella spp.
ADAHNPATRQR

SEQ ID NO: 12250 - protein, 19 aa, Brucella spp.
MATNTALSAAQKEQRREKL

SEQ ID NO: 12251 - protein, 37 aa, Brucella spp.
KRHQDGEAQREPSLDSPHQNDPVLGSSMAESTPVLDS

SEQ ID NO: 12252 - protein, 35 aa, Brucella spp.
GDIRPMSRKKRPAADLGYEGGTSRKDHKKKRHSPF

SEQ ID NO: 12253 - protein, 13 aa, Brucella spp.
DLGRGPSTGPLMS

SEQ ID NO: 12254 - protein, 13 aa, Brucella spp.
LAPLKEGEEPGGA

SEQ ID NO: 12255 - protein, 23 aa, Brucella spp.
ATRISVQGSATAEILQDGKNKFA

SEQ ID NO: 12256 - protein, 8 aa, Brucella spp.
RSSGVGDT

SEQ ID NO: 12257 - protein, 8 aa, Brucella spp.
SDDGKLTQ

SEQ ID NO: 12258 - protein, 6 aa, Brucella spp.
DCGRRR

SEQ ID NO: 12259 - protein, 4 aa, Brucella spp.
DVNE

SEQ ID NO: 12260 - protein, 12 aa, Brucella spp.
ASRKPGGAGTIT

SEQ ID NO: 12261 - protein, 10 aa, Brucella spp.
SDLSNSGKPV

SEQ ID NO: 12262 - protein, 6 aa, Brucella spp.
GWSPRA

SEQ ID NO: 12263 - protein, 6 aa, Brucella spp.
AEQGQS

SEQ ID NO: 12264 - protein, 8 aa, Brucella spp.
PTGAGKTL

SEQ ID NO: 12265 - protein, 27 aa, Brucella spp.
KRRSKAISGKVGTGFPSGIAPKSKSGV

SEQ ID NO: 12266 - protein, 20 aa, Brucella spp.
ETRTGDTPAHKRQRQKLAPP

SEQ ID NO: 12267 - protein, 7 aa, Brucella spp.
TVAEPDE

SEQ ID NO: 12268 - protein, 7 aa, Brucella spp.
QDGTGSM

SEQ ID NO: 12269 - protein, 8 aa, Brucella spp.
DGGAKPEI

SEQ ID NO: 12270 - protein, 6 aa, Brucella spp.
ERVPWA

SEQ ID NO: 12271 - protein, 4 aa, Brucella spp.
SSRY

SEQ ID NO: 12272 - protein, 11 aa, Brucella spp.
LDAGQRRKVEQ

SEQ ID NO: 12273 - protein, 8 aa, Brucella spp.
APKGASRL

SEQ ID NO: 12274 - protein, 7 aa, Brucella spp.
HRMDEPS

SEQ ID NO: 12275 - protein, 9 aa, Brucella spp.
GAQDTPPLI

SEQ ID NO: 12276 - protein, 12 aa, Brucella spp.
SAAPYANLPRDT

SEQ ID NO: 12277 - protein, 5 aa, Brucella spp.
TVDGT

SEQ ID NO: 12278 - protein, 5 aa, Brucella spp.
NPRIA

SEQ ID NO: 12279 - protein, 13 aa, Brucella spp.
TRGGKGANARGGR

SEQ ID NO: 12280 - protein, 9 aa, Brucella spp.
SNAAGQDAK

SEQ ID NO: 12281 - protein, 5 aa, Brucella spp.
LPGTD

SEQ ID NO: 12282 - protein, 13 aa, Brucella spp.
RHPGQEKTGRQVT

SEQ ID NO: 12283 - protein, 7 aa, Brucella spp.
RADAATG

SEQ ID NO: 12284 - protein, 7 aa, Brucella spp.
RVAGEGD

SEQ ID NO: 12285 - protein, 5 aa, Brucella spp.
TGANQ

SEQ ID NO: 12286 - protein, 4 aa, Brucella spp.
SSVS

SEQ ID NO: 12287 - protein, 16 aa, Brucella spp.
RRAKKGQGGAVRRSGQ

SEQ ID NO: 12288 - protein, 6 aa, Brucella spp.
ATTNQS

SEQ ID NO: 12289 - protein, 13 aa, Brucella spp.
QYGARAGRKLRGE

SEQ ID NO: 12290 - protein, 13 aa, Brucella spp.
RQRRSTSSAMQDL

SEQ ID NO: 12291 - protein, 21 aa, Brucella spp.
ELEPQKVDRAAPADARAQTSI

SEQ ID NO: 12292 - protein, 28 aa, Brucella spp.
YISPDEEAAERAFQPPHRDEAFGEPPHY

SEQ ID NO: 12293 - protein, 20 aa, Brucella spp.
DRIGTAAPEYAHPQAAPAEH

SEQ ID NO: 12294 - protein, 14 aa, Brucella spp.
KLQRPSREEAERMD

SEQ ID NO: 12295 - protein, 8 aa, Brucella spp.
AFTREDSD

SEQ ID NO: 12296 - protein, 8 aa, Brucella spp.
ANASLPEQ

SEQ ID NO: 12297 - protein, 8 aa, Brucella spp.
LSRSDYRR

SEQ ID NO: 12298 - protein, 11 aa, Brucella spp.
LDAAERRAHEH

SEQ ID NO: 12299 - protein, 13 aa, Brucella spp.
SRYGASSADSEAI

SEQ ID NO: 12300 - protein, 7 aa, Brucella spp.
AQPSREL

SEQ ID NO: 12301 - protein, 6 aa, Brucella spp.
REATES

SEQ ID NO: 12302 - protein, 10 aa, Brucella spp.
HGPKSETAIA

SEQ ID NO: 12303 - protein, 12 aa, Brucella spp.
ARNADDRNTKTF

SEQ ID NO: 12304 - protein, 14 aa, Brucella spp.
KEMSPKPAASAPIK

SEQ ID NO: 12305 - protein, 10 aa, Brucella spp.
SSPAAPAPVK

SEQ ID NO: 12306 - protein, 10 aa, Brucella spp.
AAAHTSRPHE

SEQ ID NO: 12307 - protein, 32 aa, Brucella spp.
SLKPARRENPVHTQPPAVKPDVKSGPRAGDET

SEQ ID NO: 12308 - protein, 21 aa, Brucella spp.
REERRQQEDGSEAPKTAATSK

SEQ ID NO: 12309 - protein, 27 aa, Brucella spp.
AAQLAATQSEQIAKDAAAPTEKKKASI

SEQ ID NO: 12310 - protein, 7 aa, Brucella spp.
DSDIDPA

SEQ ID NO: 12311 - protein, 8 aa, Brucella spp.
AAEKPAAI

SEQ ID NO: 12312 - protein, 12 aa, Brucella spp.
ASTGGIQTIPTT

SEQ ID NO: 12313 - protein, 19 aa, Brucella spp.
TLATPQMPPLQAESTVDDK

SEQ ID NO: 12314 - protein, 29 aa, Brucella spp.
PALPPEPQASAQFSPPETEQTAAPEPKKI

SEQ ID NO: 12315 - protein, 19 aa, Brucella spp.
SIPEEAGPAALREAAAKGD

SEQ ID NO: 12316 - protein, 10 aa, Brucella spp.
GRGVAENVKE

SEQ ID NO: 12317 - protein, 6 aa, Brucella spp.
QGFAPA

SEQ ID NO: 12318 - protein, 8 aa, Brucella spp.
ADQGNASA

SEQ ID NO: 12319 - protein, 11 aa, Brucella spp.
TGTNGTPDNAA

SEQ ID NO: 12320 - protein, 8 aa, Brucella spp.
LGVKDSQY

SEQ ID NO: 12321 - protein, 16 aa, Brucella spp.
ANAGDKDAAEKRDQIA

SEQ ID NO: 12322 - protein, 11 aa, Brucella spp.
KPLDDAANSID

SEQ ID NO: 12323 - protein, 11 aa, Brucella spp.
EAKPLSTSSVD

SEQ ID NO: 12324 - protein, 11 aa, Brucella spp.
NGYDTGTADGM

SEQ ID NO: 12325 - protein, 7 aa, Brucella spp.
AKTRTAI

SEQ ID NO: 12326 - protein, 12 aa, Brucella spp.
KANGQEPTGEVN

SEQ ID NO: 12327 - protein, 9 aa, Brucella spp.
EEDQTEDGK

SEQ ID NO: 12328 - protein, 10 aa, Brucella spp.
NRTMSGLPSS

SEQ ID NO: 12329 - protein, 13 aa, Brucella spp.
VKVPAYDRSRITT

SEQ ID NO: 12330 - protein, 7 aa, Brucella spp.
TSGSNEW

SEQ ID NO: 12331 - protein, 9 aa, Brucella spp.
RRPDTRDAL

SEQ ID NO: 12332 - protein, 8 aa, Brucella spp.
RDGDSEKL

SEQ ID NO: 12333 - protein, 6 aa, Brucella spp.
PEDPQA

SEQ ID NO: 12334 - protein, 7 aa, Brucella spp.
SGLDRSH

SEQ ID NO: 12335 - protein, 7 aa, Brucella spp.
PATPRSA

SEQ ID NO: 12336 - protein, 9 aa, Brucella spp.
RRRAQGTAP

SEQ ID NO: 12337 - protein, 8 aa, Brucella spp.
LPANGETC

SEQ ID NO: 12338 - protein, 10 aa, Brucella spp.
PATTDEDRIS

SEQ ID NO: 12339 - protein, 7 aa, Brucella spp.
FPTGRPA

SEQ ID NO: 12340 - protein, 4 aa, Brucella spp.
GSHS

SEQ ID NO: 12341 - protein, 11 aa, Brucella spp.
TVSQTTAAPGF

SEQ ID NO: 12342 - protein, 9 aa, Brucella spp.
MDGSQKLPQ

SEQ ID NO: 12343 - protein, 7 aa, Brucella spp.
RLDGGGS

SEQ ID NO: 12344 - protein, 10 aa, Brucella spp.
GKDEAGTPID

SEQ ID NO: 12345 - protein, 5 aa, Brucella spp.
DPLSG

SEQ ID NO: 12346 - protein, 9 aa, Brucella spp.
QTQGKFAPD

SEQ ID NO: 12347 - protein, 13 aa, Brucella spp.
SAETVRRYAEIAM

SEQ ID NO: 12348 - protein, 8 aa, Brucella spp.
RGAGGVGT

SEQ ID NO: 12349 - protein, 8 aa, Brucella spp.
LNTRSEGY

SEQ ID NO: 12350 - protein, 5 aa, Brucella spp.
KHPNF

SEQ ID NO: 12351 - protein, 5 aa, Brucella spp.
EEGSR

SEQ ID NO: 12352 - protein, 9 aa, Brucella spp.
QHGGTRKTI

SEQ ID NO: 12353 - protein, 9 aa, Brucella spp.
AKRSPQPLS

SEQ ID NO: 12354 - protein, 18 aa, Brucella spp.
CGGSDGYSGISANPALGY

SEQ ID NO: 12355 - protein, 13 aa, Brucella spp.
NGGTTVLSETPEI

SEQ ID NO: 12356 - protein, 5 aa, Brucella spp.
VTPAV

SEQ ID NO: 12357 - protein, 18 aa, Brucella spp.
TARNGDELNNNPSYGNKL

SEQ ID NO: 12358 - protein, 10 aa, Brucella spp.
GAVAKGGSMP

SEQ ID NO: 12359 - protein, 5 aa, Brucella spp.
GYDPV

SEQ ID NO: 12360 - protein, 5 aa, Brucella spp.
GQVAG

SEQ ID NO: 12361 - protein, 11 aa, Brucella spp.
GRGSVSGFKPS

SEQ ID NO: 12362 - protein, 10 aa, Brucella spp.
TGNETIEEAG

SEQ ID NO: 12363 - protein, 6 aa, Brucella spp.
SGQKTL

SEQ ID NO: 12364 - protein, 6 aa, Brucella spp.
AHADPK

SEQ ID NO: 12365 - protein, 6 aa, Brucella spp.
ADGTVG

SEQ ID NO: 12366 - protein, 5 aa, Brucella spp.
QDGRS

SEQ ID NO: 12367 - protein, 4 aa, Brucella spp.
SNGE

SEQ ID NO: 12368 - protein, 4 aa, Brucella spp.
NRPR

SEQ ID NO: 12369 - protein, 10 aa, Brucella spp.
QFKNGGTADG

SEQ ID NO: 12370 - protein, 5 aa, Brucella spp.
IGTGP

SEQ ID NO: 12371 - protein, 5 aa, Brucella spp.
ETKLG

SEQ ID NO: 12372 - protein, 11 aa, Brucella spp.
SYWGPKPAYEQ

SEQ ID NO: 12373 - protein, 6 aa, Brucella spp.
PDPNTR

SEQ ID NO: 12374 - protein, 9 aa, Brucella spp.
TEGPISPDT

SEQ ID NO: 12375 - protein, 4 aa, Brucella spp.
LSEP

SEQ ID NO: 12376 - protein, 9 aa, Brucella spp.
TNHGATKDL

SEQ ID NO: 12377 - protein, 7 aa, Brucella spp.
TQKRADT

SEQ ID NO: 12378 - protein, 18 aa, Brucella spp.
GWTAKASGDIREKDGQPL

SEQ ID NO: 12379 - protein, 16 aa, Brucella spp.
LTGEEESSIYARQRDG

SEQ ID NO: 12380 - protein, 5 aa, Brucella spp.
GAPYD

SEQ ID NO: 12381 - protein, 5 aa, Brucella spp.
SHADY

SEQ ID NO: 12382 - protein, 12 aa, Brucella spp.
LGLPDKAKIDAE

SEQ ID NO: 12383 - protein, 8 aa, Brucella spp.
TDETARQA

SEQ ID NO: 12384 - protein, 5 aa, Brucella spp.
KPEVG

SEQ ID NO: 12385 - protein, 5 aa, Brucella spp.
REGWQ

SEQ ID NO: 12386 - protein, 7 aa, Brucella spp.
SERSVER

SEQ ID NO: 12387 - protein, 5 aa, Brucella spp.
YNPDD

SEQ ID NO: 12388 - protein, 4 aa, Brucella spp.
SPSL

SEQ ID NO: 12389 - protein, 4 aa, Brucella spp.
LGGR

SEQ ID NO: 12390 - protein, 6 aa, Brucella spp.
SGAGPV

SEQ ID NO: 12391 - protein, 6 aa, Brucella spp.
TPPTAE

SEQ ID NO: 12392 - protein, 13 aa, Brucella spp.
DSLDPHLKAEHSH

SEQ ID NO: 12393 - protein, 6 aa, Brucella spp.
GASARK

SEQ ID NO: 12394 - protein, 5 aa, Brucella spp.
IGQGE

SEQ ID NO: 12395 - protein, 7 aa, Brucella spp.
SGCGKST

SEQ ID NO: 12396 - protein, 8 aa, Brucella spp.
ERPTSGEV

SEQ ID NO: 12397 - protein, 6 aa, Brucella spp.
LDRSGM

SEQ ID NO: 12398 - protein, 10 aa, Brucella spp.
SPGAVNARSS

SEQ ID NO: 12399 - protein, 8 aa, Brucella spp.
DETRREER

SEQ ID NO: 12400 - protein, 8 aa, Brucella spp.
PAQVSGGQ

SEQ ID NO: 12401 - protein, 5 aa, Brucella spp.
QQEGG

SEQ ID NO: 12402 - protein, 4 aa, Brucella spp.
SMRH

SEQ ID NO: 12403 - protein, 13 aa, Brucella spp.
TPRGRGKKDGSLH

SEQ ID NO: 12404 - protein, 10 aa, Brucella spp.
RDRNGIDTAK

SEQ ID NO: 12405 - protein, 4 aa, Brucella spp.
VGEA

SEQ ID NO: 12406 - protein, 5 aa, Brucella spp.
FSRDD

SEQ ID NO: 12407 - protein, 13 aa, Brucella spp.
AVESQKRAANSWE

SEQ ID NO: 12408 - protein, 7 aa, Brucella spp.
HMRPGTD

SEQ ID NO: 12409 - protein, 10 aa, Brucella spp.
AGNSSGIVDG

SEQ ID NO: 12410 - protein, 9 aa, Brucella spp.
SRKAGKAFD

SEQ ID NO: 12411 - protein, 4 aa, Brucella spp.
GSEP

SEQ ID NO: 12412 - protein, 10 aa, Brucella spp.
SGKETFSGGA

SEQ ID NO: 12413 - protein, 10 aa, Brucella spp.
QKVKDPEGAV

SEQ ID NO: 12414 - protein, 9 aa, Brucella spp.
RAASDAPGV

SEQ ID NO: 12415 - protein, 10 aa, Brucella spp.
PGAGGTQRVP

SEQ ID NO: 12416 - protein, 6 aa, Brucella spp.
LANQQD

SEQ ID NO: 12417 - protein, 10 aa, Brucella spp.
GSSLTAQRAK

SEQ ID NO: 12418 - protein, 4 aa, Brucella spp.
LVET

SEQ ID NO: 12419 - protein, 7 aa, Brucella spp.
KPVQPWD

SEQ ID NO: 12420 - protein, 5 aa, Brucella spp.
KLPGG

SEQ ID NO: 12421 - protein, 9 aa, Brucella spp.
RETSGNYPA

SEQ ID NO: 12422 - protein, 15 aa, Brucella spp.
NKGARRPVDEKPTRL

SEQ ID NO: 12423 - protein, 14 aa, Brucella spp.
DQESADKGKAHTAD

SEQ ID NO: 12424 - protein, 12 aa, Brucella spp.
MQKGRATEADKE

SEQ ID NO: 12425 - protein, 7 aa, Brucella spp.
TPDYAQL

SEQ ID NO: 12426 - protein, 11 aa, Brucella spp.
RVATEKAEEVL

SEQ ID NO: 12427 - protein, 9 aa, Brucella spp.
ASNTSTLPI

SEQ ID NO: 12428 - protein, 7 aa, Brucella spp.
VSKRPKN

SEQ ID NO: 12429 - protein, 8 aa, Brucella spp.
KKTSDKAL

SEQ ID NO: 12430 - protein, 5 aa, Brucella spp.
DETAI

SEQ ID NO: 12431 - protein, 11 aa, Brucella spp.
ADLGPKAVDPR

SEQ ID NO: 12432 - protein, 11 aa, Brucella spp.
DRKGRKNGKGF

SEQ ID NO: 12433 - protein, 8 aa, Brucella spp.
YPAKPAKK

SEQ ID NO: 12434 - protein, 10 aa, Brucella spp.
YPQQNPDKID

SEQ ID NO: 12435 - protein, 8 aa, Brucella spp.
TDPREADV

SEQ ID NO: 12436 - protein, 5 aa, Brucella spp.
YTGGT

SEQ ID NO: 12437 - protein, 9 aa, Brucella spp.
LQKKYGAQF

SEQ ID NO: 12438 - protein, 5 aa, Brucella spp.
ENGET

SEQ ID NO: 12439 - protein, 14 aa, Brucella spp.
SGSAEKSDKGAKNG

SEQ ID NO: 12440 - protein, 58 aa, Brucella spp.
YNEPETAPELDTAQQAVPQPSQSAPAEGQPPAWKENGKANDHVNDTGMEREAPRPPLS

SEQ ID NO: 12441 - protein, 22 aa, Brucella spp.
LASTPKPPEPQPPATSVDAGEQ

SEQ ID NO: 12442 - protein, 10 aa, Brucella spp.
GRLESQGRTI

SEQ ID NO: 12443 - protein, 11 aa, Brucella spp.
TCETASGESWP

SEQ ID NO: 12444 - protein, 10 aa, Brucella spp.
PENDSGAAVS

SEQ ID NO: 12445 - protein, 16 aa, Brucella spp.
KAVPGGTYDEAGRKAV

SEQ ID NO: 12446 - protein, 49 aa, Brucella spp.
DKPDTSLLNPESDSGNMLDNPSPLAPEQEPQPSSPSLQQGDFPPAPAAQ

SEQ ID NO: 12447 - protein, 8 aa, Brucella spp.
TAAAAEAK

SEQ ID NO: 12448 - protein, 7 aa, Brucella spp.
AKTGLPE

SEQ ID NO: 12449 - protein, 8 aa, Brucella spp.
GYGPSGLP

SEQ ID NO: 12450 - protein, 10 aa, Brucella spp.
VPDNVPDRAA

SEQ ID NO: 12451 - protein, 8 aa, Brucella spp.
VPNPFGGD

SEQ ID NO: 12452 - protein, 4 aa, Brucella spp.
FAEH

SEQ ID NO: 12453 - protein, 7 aa, Brucella spp.
ATEYYRS

SEQ ID NO: 12454 - protein, 8 aa, Brucella spp.
GEERQATY

SEQ ID NO: 12455 - protein, 5 aa, Brucella spp.
SPKSG

SEQ ID NO: 12456 - protein, 25 aa, Brucella spp.
DAKAGTITFDDEDGEETTLSVTGGK

SEQ ID NO: 12457 - protein, 7 aa, Brucella spp.
DHQTNAG

SEQ ID NO: 12458 - protein, 12 aa, Brucella spp.
QKISKSKGNGIS

SEQ ID NO: 12459 - protein, 4 aa, Brucella spp.
PTES

SEQ ID NO: 12460 - protein, 6 aa, Brucella spp.
KPKTAK

SEQ ID NO: 12461 - protein, 5 aa, Brucella spp.
ARQEW

SEQ ID NO: 12462 - protein, 8 aa, Brucella spp.
GNPPKADL

SEQ ID NO: 12463 - protein, 8 aa, Brucella spp.
ASNAESPA

SEQ ID NO: 12464 - protein, 10 aa, Brucella spp.
GVTPENNPEL

SEQ ID NO: 12465 - protein, 12 aa, Brucella spp.
TKKFRAPDDVER

SEQ ID NO: 12466 - protein, 11 aa, Brucella spp.
GELPAGTDGNV

SEQ ID NO: 12467 - protein, 16 aa, Brucella spp.
RYQDHTKKSPEGGPGV

SEQ ID NO: 12468 - protein, 7 aa, Brucella spp.
QERGPRF

SEQ ID NO: 12469 - protein, 7 aa, Brucella spp.
LDSEEPV

SEQ ID NO: 12470 - protein, 8 aa, Brucella spp.
DTVPRDTL

SEQ ID NO: 12471 - protein, 11 aa, Brucella spp.
ERWRDNSTFAE

SEQ ID NO: 12472 - protein, 5 aa, Brucella spp.
EALRE

SEQ ID NO: 12473 - protein, 7 aa, Brucella spp.
ADLPADL

SEQ ID NO: 12474 - protein, 6 aa, Brucella spp.
TPAAIG

SEQ ID NO: 12475 - protein, 8 aa, Brucella spp.
ANVSDANE

SEQ ID NO: 12476 - protein, 12 aa, Brucella spp.
TSGKVASVDEEG

SEQ ID NO: 12477 - protein, 8 aa, Brucella spp.
AVSGSGPA

SEQ ID NO: 12478 - protein, 5 aa, Brucella spp.
LPRET

SEQ ID NO: 12479 - protein, 25 aa, Brucella spp.
LADASTDSPSKLREQVTSPNGTTAA

SEQ ID NO: 12480 - protein, 12 aa, Brucella spp.
AAHKRSVELGKS

SEQ ID NO: 12481 - protein, 6 aa, Brucella spp.
KLAEDV

SEQ ID NO: 12482 - protein, 8 aa, Brucella spp.
TVKTETEK

SEQ ID NO: 12483 - protein, 7 aa, Brucella spp.
EDPASQV

SEQ ID NO: 12484 - protein, 9 aa, Brucella spp.
SKSRKAKEC

SEQ ID NO: 12485 - protein, 9 aa, Brucella spp.
DLPETASEQ

SEQ ID NO: 12486 - protein, 5 aa, Brucella spp.
NNDPA

SEQ ID NO: 12487 - protein, 6 aa, Brucella spp.
APEKDV

SEQ ID NO: 12488 - protein, 7 aa, Brucella spp.
LGTGEVE

SEQ ID NO: 12489 - protein, 4 aa, Brucella spp.
RDLS

SEQ ID NO: 12490 - protein, 10 aa, Brucella spp.
HSRTKDLPAI

SEQ ID NO: 12491 - protein, 4 aa, Brucella spp.
RPQM

SEQ ID NO: 12492 - protein, 5 aa, Brucella spp.
VKPGA

SEQ ID NO: 12493 - protein, 13 aa, Brucella spp.
IPAPERGEGKTRL

SEQ ID NO: 12494 - protein, 4 aa, Brucella spp.
EAEK

SEQ ID NO: 12495 - protein, 11 aa, Brucella spp.
GAITPVPGGVG

SEQ ID NO: 12496 - protein, 11 aa, Brucella spp.
IRERSKPTREA

SEQ ID NO: 12497 - protein, 10 aa, Brucella spp.
EAASNKPKRS

SEQ ID NO: 12498 - protein, 8 aa, Brucella spp.
GPHDKAAL

SEQ ID NO: 12499 - protein, 11 aa, Brucella spp.
AAREAGGVAQV

SEQ ID NO: 12500 - protein, 17 aa, Brucella spp.
PMTSGLPNDEKAKTRQL

SEQ ID NO: 12501 - protein, 6 aa, Brucella spp.
GKVGRA

SEQ ID NO: 12502 - protein, 11 aa, Brucella spp.
ESESKSYHGPG

SEQ ID NO: 12503 - protein, 5 aa, Brucella spp.
TANSN

SEQ ID NO: 12504 - protein, 7 aa, Brucella spp.
NPGTPLR

SEQ ID NO: 12505 - protein, 7 aa, Brucella spp.
LTREAAK

SEQ ID NO: 12506 - protein, 6 aa, Brucella spp.
NEYTPV

SEQ ID NO: 12507 - protein, 9 aa, Brucella spp.
NATGGSTNH

SEQ ID NO: 12508 - protein, 9 aa, Brucella spp.
PKLGPDGNV

SEQ ID NO: 12509 - protein, 13 aa, Brucella spp.
REAAPEKSGDDKV

SEQ ID NO: 12510 - protein, 7 aa, Brucella spp.
PFQPTGG

SEQ ID NO: 12511 - protein, 4 aa, Brucella spp.
VKPK

SEQ ID NO: 12512 - protein, 5 aa, Brucella spp.
AGDLT

SEQ ID NO: 12513 - protein, 9 aa, Brucella spp.
QGPKANGMP

SEQ ID NO: 12514 - protein, 4 aa, Brucella spp.
DRGQ

SEQ ID NO: 12515 - protein, 12 aa, Brucella spp.
GRLSGASGKVPS

SEQ ID NO: 12516 - protein, 15 aa, Brucella spp.
RIEERPDLSGNEYGM

SEQ ID NO: 12517 - protein, 4 aa, Brucella spp.
AQSL

SEQ ID NO: 12518 - protein, 6 aa, Brucella spp.
IAERGQ

SEQ ID NO: 12519 - protein, 6 aa, Brucella spp.
SGGTTP

SEQ ID NO: 12520 - protein, 9 aa, Brucella spp.
ENERSNEKL

SEQ ID NO: 12521 - protein, 10 aa, Brucella spp.
PAATAETAAL

SEQ ID NO: 12522 - protein, 7 aa, Brucella spp.
GNDGHTA

SEQ ID NO: 12523 - protein, 7 aa, Brucella spp.
QAINPAT

SEQ ID NO: 12524 - protein, 7 aa, Brucella spp.
EGAGEKR

SEQ ID NO: 12525 - protein, 8 aa, Brucella spp.
AAKQATLE

SEQ ID NO: 12526 - protein, 10 aa, Brucella spp.
ALAGDDEREM

SEQ ID NO: 12527 - protein, 6 aa, Brucella spp.
TGDLAE

SEQ ID NO: 12528 - protein, 12 aa, Brucella spp.
QRAGQLSDPTRI

SEQ ID NO: 12529 - protein, 13 aa, Brucella spp.
SRSQMTDDEYRTF

SEQ ID NO: 12530 - protein, 9 aa, Brucella spp.
VKPEEVDQA

SEQ ID NO: 12531 - protein, 8 aa, Brucella spp.
AKSDEGWD

SEQ ID NO: 12532 - protein, 7 aa, Brucella spp.
GKKPEKI

SEQ ID NO: 12533 - protein, 14 aa, Brucella spp.
IGRDLDSAKALNDT

SEQ ID NO: 12534 - protein, 13 aa, Brucella spp.
GLEGRAGYYDKAG

SEQ ID NO: 12535 - protein, 12 aa, Brucella spp.
PPSSIEADAVHD

SEQ ID NO: 12536 - protein, 15 aa, Brucella spp.
GQYRAGASAGGPVKG

SEQ ID NO: 12537 - protein, 10 aa, Brucella spp.
LESDTSNTET

SEQ ID NO: 12538 - protein, 5 aa, Brucella spp.
RLATR

SEQ ID NO: 12539 - protein, 5 aa, Brucella spp.
ESAGK

SEQ ID NO: 12540 - protein, 5 aa, Brucella spp.
PDEGV

SEQ ID NO: 12541 - protein, 7 aa, Brucella spp.
DPGPGGM

SEQ ID NO: 12542 - protein, 9 aa, Brucella spp.
FEDRNPDAY

SEQ ID NO: 12543 - protein, 17 aa, Brucella spp.
SQPVQGYTAGTWGPSSS

SEQ ID NO: 12544 - protein, 4 aa, Brucella spp.
TLSN

SEQ ID NO: 12545 - protein, 6 aa, Brucella spp.
SDKPAN

SEQ ID NO: 12546 - protein, 7 aa, Brucella spp.
GKPAWRS

SEQ ID NO: 12547 - protein, 6 aa, Brucella spp.
AAHTGL

SEQ ID NO: 12548 - protein, 4 aa, Brucella spp.
GGSE

SEQ ID NO: 12549 - protein, 12 aa, Brucella spp.
DAKRRQAKGVNA

SEQ ID NO: 12550 - protein, 4 aa, Brucella spp.
AISG

SEQ ID NO: 12551 - protein, 4 aa, Brucella spp.
KQGT

SEQ ID NO: 12552 - protein, 20 aa, Brucella spp.
LGDGASGRNGGQFGTGQRTW

SEQ ID NO: 12553 - protein, 7 aa, Brucella spp.
ETEYGYE

SEQ ID NO: 12554 - protein, 5 aa, Brucella spp.
ETAEL

SEQ ID NO: 12555 - protein, 7 aa, Brucella spp.
YDSATGH

SEQ ID NO: 12556 - protein, 7 aa, Brucella spp.
KAAHTAG

SEQ ID NO: 12557 - protein, 24 aa, Brucella spp.
EDTKATKISTASGRVEVETTRGTI

SEQ ID NO: 12558 - protein, 7 aa, Brucella spp.
GGRLEPV

SEQ ID NO: 12559 - protein, 20 aa, Brucella spp.
TAPLGDDSPVIPGGESVDDS

SEQ ID NO: 12560 - protein, 4 aa, Brucella spp.
SKDG

SEQ ID NO: 12561 - protein, 12 aa, Brucella spp.
EAYTADNPRDIS

SEQ ID NO: 12562 - protein, 7 aa, Brucella spp.
AGGYSGH

SEQ ID NO: 12563 - protein, 6 aa, Brucella spp.
LAGRRE

SEQ ID NO: 12564 - protein, 7 aa, Brucella spp.
PFPGGRT

SEQ ID NO: 12565 - protein, 7 aa, Brucella spp.
GCKPKDA

SEQ ID NO: 12566 - protein, 12 aa, Brucella spp.
NNSPVPYGGPRG

SEQ ID NO: 12567 - protein, 16 aa, Brucella spp.
EPTGQGAISLEPGGQF

SEQ ID NO: 12568 - protein, 5 aa, Brucella spp.
GAPLS

SEQ ID NO: 12569 - protein, 7 aa, Brucella spp.
GGSPKWT

SEQ ID NO: 12570 - protein, 8 aa, Brucella spp.
ETPAMPKS

SEQ ID NO: 12571 - protein, 7 aa, Brucella spp.
SSEQDMR

SEQ ID NO: 12572 - protein, 11 aa, Brucella spp.
SPFTEGKPNGL

SEQ ID NO: 12573 - protein, 8 aa, Brucella spp.
DTDNQRSG

SEQ ID NO: 12574 - protein, 11 aa, Brucella spp.
KGEVSDPVPNM

SEQ ID NO: 12575 - protein, 7 aa, Brucella spp.
GADGGPW

SEQ ID NO: 12576 - protein, 7 aa, Brucella spp.
EVPTKAL

SEQ ID NO: 12577 - protein, 4 aa, Brucella spp.
TDFH

SEQ ID NO: 12578 - protein, 9 aa, Brucella spp.
KLNSDGYDE

SEQ ID NO: 12579 - protein, 7 aa, Brucella spp.
ATTDAER

SEQ ID NO: 12580 - protein, 6 aa, Brucella spp.
DAGAQA

SEQ ID NO: 12581 - protein, 6 aa, Brucella spp.
RDGEWK

SEQ ID NO: 12582 - protein, 7 aa, Brucella spp.
SLQPEGR

SEQ ID NO: 12583 - protein, 11 aa, Brucella spp.
EQTRPQPKPSE

SEQ ID NO: 12584 - protein, 8 aa, Brucella spp.
GHESDDPL

SEQ ID NO: 12585 - protein, 7 aa, Brucella spp.
LEPGPSG

SEQ ID NO: 12586 - protein, 10 aa, Brucella spp.
PEGGFSEEER

SEQ ID NO: 12587 - protein, 7 aa, Brucella spp.
WTRDGKI

SEQ ID NO: 12588 - protein, 5 aa, Brucella spp.
QTVHK

SEQ ID NO: 12589 - protein, 14 aa, Brucella spp.
TAEAKADSSKAALD

SEQ ID NO: 12590 - protein, 7 aa, Brucella spp.
DTTVTRQ

SEQ ID NO: 12591 - protein, 20 aa, Brucella spp.
EQVETAAQQAEAAHRQAELD

SEQ ID NO: 12592 - protein, 5 aa, Brucella spp.
KAPVN

SEQ ID NO: 12593 - protein, 11 aa, Brucella spp.
QPGDYVSAGSA

SEQ ID NO: 12594 - protein, 21 aa, Brucella spp.
KGKVEGIAGGIEDRERSDSQS

SEQ ID NO: 12595 - protein, 11 aa, Brucella spp.
SGSSLAGETRY

SEQ ID NO: 12596 - protein, 6 aa, Brucella spp.
IGQSSA

SEQ ID NO: 12597 - protein, 9 aa, Brucella spp.
LADNDPSLE

SEQ ID NO: 12598 - protein, 5 aa, Brucella spp.
KPEQF

SEQ ID NO: 12599 - protein, 10 aa, Brucella spp.
VNSGKGDGVR

SEQ ID NO: 12600 - protein, 6 aa, Brucella spp.
DRGEKV

SEQ ID NO: 12601 - protein, 16 aa, Brucella spp.
AREEAARKKIASANGR

SEQ ID NO: 12602 - protein, 8 aa, Brucella spp.
AGKNGAPA

SEQ ID NO: 12603 - protein, 6 aa, Brucella spp.
SEEEWP

SEQ ID NO: 12604 - protein, 6 aa, Brucella spp.
AKSDPT

SEQ ID NO: 12605 - protein, 8 aa, Brucella spp.
RRRYPADD

SEQ ID NO: 12606 - protein, 4 aa, Brucella spp.
MNPT

SEQ ID NO: 12607 - protein, 10 aa, Brucella spp.
KAQAHADAAG

SEQ ID NO: 12608 - protein, 7 aa, Brucella spp.
DNKTSLA

SEQ ID NO: 12609 - protein, 8 aa, Brucella spp.
VQTPGQAR

SEQ ID NO: 12610 - protein, 10 aa, Brucella spp.
PATGRGDEAE

SEQ ID NO: 12611 - protein, 9 aa, Brucella spp.
TISSGGTPD

SEQ ID NO: 12612 - protein, 4 aa, Brucella spp.
EYRP

SEQ ID NO: 12613 - protein, 7 aa, Brucella spp.
AEGAATI

SEQ ID NO: 12614 - protein, 7 aa, Brucella spp.
SHPTPER

SEQ ID NO: 12615 - protein, 10 aa, Brucella spp.
GSKALSSDTL

SEQ ID NO: 12616 - protein, 12 aa, Brucella spp.
GLSEEHGKVTGD

SEQ ID NO: 12617 - protein, 13 aa, Brucella spp.
YRPQNYNRGHRPG

SEQ ID NO: 12618 - protein, 15 aa, Brucella spp.
SQPRPVYRAPAGSPH

SEQ ID NO: 12619 - protein, 26 aa, Brucella spp.
KSYRASDNTFQPYNGPRKQCRSPYSR

SEQ ID NO: 12620 - protein, 7 aa, Brucella spp.
RLSPREL

SEQ ID NO: 12621 - protein, 7 aa, Brucella spp.
EKAGARF

SEQ ID NO: 12622 - protein, 6 aa, Brucella spp.
SGADAA

SEQ ID NO: 12623 - protein, 6 aa, Brucella spp.
KTGQSK

SEQ ID NO: 12624 - protein, 8 aa, Brucella spp.
AGNADADI

SEQ ID NO: 12625 - protein, 11 aa, Brucella spp.
EAASGKAVKVN

SEQ ID NO: 12626 - protein, 6 aa, Brucella spp.
GPEAEA

SEQ ID NO: 12627 - protein, 6 aa, Brucella spp.
AGLPGA

SEQ ID NO: 12628 - protein, 8 aa, Brucella spp.
SGYTGEDG

SEQ ID NO: 12629 - protein, 7 aa, Brucella spp.
PADEARA

SEQ ID NO: 12630 - protein, 11 aa, Brucella spp.
DITPETDPVSA

SEQ ID NO: 12631 - protein, 8 aa, Brucella spp.
EKAAFNGA

SEQ ID NO: 12632 - protein, 22 aa, Brucella spp.
AKGASAKRVGLKPEGRQPVRAG

SEQ ID NO: 12633 - protein, 20 aa, Brucella spp.
DESGRQIGTVTSGGFGPSAG

SEQ ID NO: 12634 - protein, 7 aa, Brucella spp.
LATPGTR

SEQ ID NO: 12635 - protein, 5 aa, Brucella spp.
GNKVP

SEQ ID NO: 12636 - protein, 8 aa, Brucella spp.
GRTVAKGD

SEQ ID NO: 12637 - protein, 10 aa, Brucella spp.
KAASDVYAPV

SEQ ID NO: 12638 - protein, 9 aa, Brucella spp.
AVASDPSLI

SEQ ID NO: 12639 - protein, 7 aa, Brucella spp.
NQAAEGE

SEQ ID NO: 12640 - protein, 6 aa, Brucella spp.
DEGQLT

SEQ ID NO: 12641 - protein, 7 aa, Brucella spp.
PPIREQS

SEQ ID NO: 12642 - protein, 6 aa, Brucella spp.
YRRPEA

SEQ ID NO: 12643 - protein, 17 aa, Brucella spp.
EQATLPEETRQQIRSTA

SEQ ID NO: 12644 - protein, 8 aa, Brucella spp.
KHKGTGIE

SEQ ID NO: 12645 - protein, 6 aa, Brucella spp.
LSSQEG

SEQ ID NO: 12646 - protein, 6 aa, Brucella spp.
ISNGDW

SEQ ID NO: 12647 - protein, 6 aa, Brucella spp.
SHIGGG

SEQ ID NO: 12648 - protein, 11 aa, Brucella spp.
LTNTVNDRGLS

SEQ ID NO: 12649 - protein, 7 aa, Brucella spp.
GETIDEA

SEQ ID NO: 12650 - protein, 9 aa, Brucella spp.
RAKELEERG

SEQ ID NO: 12651 - protein, 13 aa, Brucella spp.
EAATTAADAERYY

SEQ ID NO: 12652 - protein, 14 aa, Brucella spp.
RASAGRGIYDGPGI

SEQ ID NO: 12653 - protein, 9 aa, Brucella spp.
RYTRAQSER

SEQ ID NO: 12654 - protein, 6 aa, Brucella spp.
AEEADR

SEQ ID NO: 12655 - protein, 5 aa, Brucella spp.
DPDLA

SEQ ID NO: 12656 - protein, 4 aa, Brucella spp.
RTKR

SEQ ID NO: 12657 - protein, 6 aa, Brucella spp.
RAQVDG

SEQ ID NO: 12658 - protein, 6 aa, Brucella spp.
PDFKTG

SEQ ID NO: 12659 - protein, 9 aa, Brucella spp.
GPEKLGRPA

SEQ ID NO: 12660 - protein, 6 aa, Brucella spp.
NGANSS

SEQ ID NO: 12661 - protein, 5 aa, Brucella spp.
DKNVS

SEQ ID NO: 12662 - protein, 10 aa, Brucella spp.
GARRNSAGFD

SEQ ID NO: 12663 - protein, 27 aa, Brucella spp.
TLKETAGRAWTAEPQVAGAKVKGVSRP

SEQ ID NO: 12664 - protein, 11 aa, Brucella spp.
VLNPGDRNDVV

SEQ ID NO: 12665 - protein, 11 aa, Brucella spp.
MKAAQTATTSW

SEQ ID NO: 12666 - protein, 6 aa, Brucella spp.
VAPAER

SEQ ID NO: 12667 - protein, 8 aa, Brucella spp.
AGKSMPNA

SEQ ID NO: 12668 - protein, 6 aa, Brucella spp.
QTRRTL

SEQ ID NO: 12669 - protein, 9 aa, Brucella spp.
AKPAEETPL

SEQ ID NO: 12670 - protein, 4 aa, Brucella spp.
GIPA

SEQ ID NO: 12671 - protein, 6 aa, Brucella spp.
PGDGRI

SEQ ID NO: 12672 - protein, 7 aa, Brucella spp.
LPNGKPV

SEQ ID NO: 12673 - protein, 6 aa, Brucella spp.
ETGGQN

SEQ ID NO: 12674 - protein, 8 aa, Brucella spp.
FDSAGQRC

SEQ ID NO: 12675 - protein, 5 aa, Brucella spp.
GRTDQ

SEQ ID NO: 12676 - protein, 8 aa, Brucella spp.
DEAKNTIE

SEQ ID NO: 12677 - protein, 10 aa, Brucella spp.
PLGPETQNGT

SEQ ID NO: 12678 - protein, 4 aa, Brucella spp.
RDDM

SEQ ID NO: 12679 - protein, 5 aa, Brucella spp.
NSTGY

SEQ ID NO: 12680 - protein, 18 aa, Brucella spp.
PFGGRGLSGTGPKAGGPL

SEQ ID NO: 12681 - protein, 7 aa, Brucella spp.
APIPPRH

SEQ ID NO: 12682 - protein, 12 aa, Brucella spp.
QAARDTGSASAL

SEQ ID NO: 12683 - protein, 7 aa, Brucella spp.
PGPVGER

SEQ ID NO: 12684 - protein, 5 aa, Brucella spp.
TGNTA

SEQ ID NO: 12685 - protein, 5 aa, Brucella spp.
LPETV

SEQ ID NO: 12686 - protein, 5 aa, Brucella spp.
ADAPF

SEQ ID NO: 12687 - protein, 9 aa, Brucella spp.
GDSARIKEV

SEQ ID NO: 12688 - protein, 12 aa, Brucella spp.
AASPEDLAANQD

SEQ ID NO: 12689 - protein, 18 aa, Brucella spp.
TSINTTAAGGNASLMAIG

SEQ ID NO: 12690 - protein, 4 aa, Brucella spp.
NGKV

SEQ ID NO: 12691 - protein, 8 aa, Brucella spp.
DITPESAG

SEQ ID NO: 12692 - protein, 12 aa, Brucella spp.
AGESAAEKTGAR

SEQ ID NO: 12693 - protein, 13 aa, Brucella spp.
AEISASGEAFGEM

SEQ ID NO: 12694 - protein, 10 aa, Brucella spp.
ESEWSATATT

SEQ ID NO: 12695 - protein, 17 aa, Brucella spp.
APGKPGRKAQKLGPEGL

SEQ ID NO: 12696 - protein, 11 aa, Brucella spp.
LEQRGKGANTR

SEQ ID NO: 12697 - protein, 4 aa, Brucella spp.
GRDV

SEQ ID NO: 12698 - protein, 20 aa, Brucella spp.
PQGNWSSYPPHRHDEDSFPD

SEQ ID NO: 12699 - protein, 8 aa, Brucella spp.
EDGSLDET

SEQ ID NO: 12700 - protein, 6 aa, Brucella spp.
HPCGAP

SEQ ID NO: 12701 - protein, 7 aa, Brucella spp.
QMTPEGD

SEQ ID NO: 12702 - protein, 6 aa, Brucella spp.
HNEQTM

SEQ ID NO: 12703 - protein, 5 aa, Brucella spp.
QLGRR

SEQ ID NO: 12704 - protein, 9 aa, Brucella spp.
SSIGPGATN

SEQ ID NO: 12705 - protein, 8 aa, Brucella spp.
ANRGPDPV

SEQ ID NO: 12706 - protein, 5 aa, Brucella spp.
NDGTM

SEQ ID NO: 12707 - protein, 8 aa, Brucella spp.
TDPADCGP

SEQ ID NO: 12708 - protein, 12 aa, Brucella spp.
RPPPDERELETA

SEQ ID NO: 12709 - protein, 9 aa, Brucella spp.
TQAGKSALP

SEQ ID NO: 12710 - protein, 13 aa, Brucella spp.
GVTGADSANAVAA

SEQ ID NO: 12711 - protein, 11 aa, Brucella spp.
QPYDGAKHNSL

SEQ ID NO: 12712 - protein, 4 aa, Brucella spp.
VDAS

SEQ ID NO: 12713 - protein, 13 aa, Brucella spp.
FTAAPSDGNALPT

SEQ ID NO: 12714 - protein, 6 aa, Brucella spp.
RQAREN

SEQ ID NO: 12715 - protein, 4 aa, Brucella spp.
TMPG

SEQ ID NO: 12716 - protein, 5 aa, Brucella spp.
AEPDR

SEQ ID NO: 12717 - protein, 5 aa, Brucella spp.
TGGAE

SEQ ID NO: 12718 - protein, 5 aa, Brucella spp.
VNPSQ

SEQ ID NO: 12719 - protein, 13 aa, Brucella spp.
AMGADAKKVGSIR

SEQ ID NO: 12720 - protein, 8 aa, Brucella spp.
AEARDSLR

SEQ ID NO: 12721 - protein, 9 aa, Brucella spp.
DPYPTPETG

SEQ ID NO: 12722 - protein, 23 aa, Brucella spp.
EVSERDEVRAARKNYEAQIKERN

SEQ ID NO: 12723 - protein, 14 aa, Brucella spp.
VGGSPTNIATGTAR

SEQ ID NO: 12724 - protein, 8 aa, Brucella spp.
REGVDTRG

SEQ ID NO: 12725 - protein, 6 aa, Brucella spp.
VTDPER

SEQ ID NO: 12726 - protein, 8 aa, Brucella spp.
LSHPRTEA

SEQ ID NO: 12727 - protein, 8 aa, Brucella spp.
RENGSRTA

SEQ ID NO: 12728 - protein, 8 aa, Brucella spp.
GHGDGENR

SEQ ID NO: 12729 - protein, 4 aa, Brucella spp.
TAKL

SEQ ID NO: 12730 - protein, 8 aa, Brucella spp.
GGSTDTLE

SEQ ID NO: 12731 - protein, 15 aa, Brucella spp.
DIPDDLDKGQSGQGF

SEQ ID NO: 12732 - protein, 5 aa, Brucella spp.
EDWPT

SEQ ID NO: 12733 - protein, 8 aa, Brucella spp.
GCTPAYPS

SEQ ID NO: 12734 - protein, 9 aa, Brucella spp.
NKALRKDAE

SEQ ID NO: 12735 - protein, 7 aa, Brucella spp.
TNRNGTW

SEQ ID NO: 12736 - protein, 11 aa, Brucella spp.
AEAGASTDKIG

SEQ ID NO: 12737 - protein, 8 aa, Brucella spp.
VAGGAQGY

SEQ ID NO: 12738 - protein, 8 aa, Brucella spp.
AEWPGSRP

SEQ ID NO: 12739 - protein, 8 aa, Brucella spp.
EPELGPDC

SEQ ID NO: 12740 - protein, 14 aa, Brucella spp.
DDPAEMRAGQEETV

SEQ ID NO: 12741 - protein, 9 aa, Brucella spp.
SKAGPVDDM

SEQ ID NO: 12742 - protein, 5 aa, Brucella spp.
KTKAA

SEQ ID NO: 12743 - protein, 9 aa, Brucella spp.
ITRNDPHTR

SEQ ID NO: 12744 - protein, 8 aa, Brucella spp.
APAEELEQ

SEQ ID NO: 12745 - protein, 5 aa, Brucella spp.
IDDAQ

SEQ ID NO: 12746 - protein, 4 aa, Brucella spp.
ASIK

SEQ ID NO: 12747 - protein, 5 aa, Brucella spp.
NQDRI

SEQ ID NO: 12748 - protein, 8 aa, Brucella spp.
AEGAGVQS

SEQ ID NO: 12749 - protein, 6 aa, Brucella spp.
GGWPDY

SEQ ID NO: 12750 - protein, 7 aa, Brucella spp.
TAAGRAP

SEQ ID NO: 12751 - protein, 8 aa, Brucella spp.
EAGRTSLE

SEQ ID NO: 12752 - protein, 5 aa, Brucella spp.
EPEAL

SEQ ID NO: 12753 - protein, 7 aa, Brucella spp.
PYSPETI

SEQ ID NO: 12754 - protein, 7 aa, Brucella spp.
ARSPIRD

SEQ ID NO: 12755 - protein, 8 aa, Brucella spp.
DSRTPSHA

SEQ ID NO: 12756 - protein, 5 aa, Brucella spp.
LSPAG

SEQ ID NO: 12757 - protein, 16 aa, Brucella spp.
APRDAERPETDEDDPL

SEQ ID NO: 12758 - protein, 12 aa, Brucella spp.
ANRRKPKAVPRD

SEQ ID NO: 12759 - protein, 6 aa, Brucella spp.
WDEDAR

SEQ ID NO: 12760 - protein, 4 aa, Brucella spp.
DLPP

SEQ ID NO: 12761 - protein, 12 aa, Brucella spp.
NKRPDERRSSNR

SEQ ID NO: 12762 - protein, 11 aa, Brucella spp.
LKGRRSNSRLP

SEQ ID NO: 12763 - protein, 4 aa, Brucella spp.
VTQQ

SEQ ID NO: 12764 - protein, 13 aa, Brucella spp.
ITGRGRFRAWGIL

SEQ ID NO: 12765 - protein, 14 aa, Brucella spp.
VKPGFNHHEENGVS

SEQ ID NO: 12766 - protein, 6 aa, Brucella spp.
EQSFPG

SEQ ID NO: 12767 - protein, 5 aa, Brucella spp.
EFEDR

SEQ ID NO: 12768 - protein, 7 aa, Brucella spp.
GGSTDNE

SEQ ID NO: 12769 - protein, 5 aa, Brucella spp.
TNGSL

SEQ ID NO: 12770 - protein, 9 aa, Brucella spp.
VRSPDGGAY

SEQ ID NO: 12771 - protein, 8 aa, Brucella spp.
VGRAPKDT

SEQ ID NO: 12772 - protein, 6 aa, Brucella spp.
APPLPL

SEQ ID NO: 12773 - protein, 6 aa, Brucella spp.
EPDASG

SEQ ID NO: 12774 - protein, 19 aa, Brucella spp.
KGRHSFAKGSTAASAGING

SEQ ID NO: 12775 - protein, 6 aa, Brucella spp.
AMDEET

SEQ ID NO: 12776 - protein, 6 aa, Brucella spp.
DGGPHN

SEQ ID NO: 12777 - protein, 6 aa, Brucella spp.
GAKWEP

SEQ ID NO: 12778 - protein, 5 aa, Brucella spp.
VNQPA

SEQ ID NO: 12779 - protein, 13 aa, Brucella spp.
GKDAERGLPETYG

SEQ ID NO: 12780 - protein, 6 aa, Brucella spp.
APEARV

SEQ ID NO: 12781 - protein, 4 aa, Brucella spp.
GGFI

SEQ ID NO: 12782 - protein, 6 aa, Brucella spp.
ISPGER

SEQ ID NO: 12783 - protein, 4 aa, Brucella spp.
NGEA

SEQ ID NO: 12784 - protein, 9 aa, Brucella spp.
YGDNGSGDG

SEQ ID NO: 12785 - protein, 25 aa, Brucella spp.
ALEGRVAKPPVSLDGPAAPDEKLSV

SEQ ID NO: 12786 - protein, 13 aa, Brucella spp.
QPSSNPHASGDDM

SEQ ID NO: 12787 - protein, 15 aa, Brucella spp.
HGSRSAADAGPALDA

SEQ ID NO: 12788 - protein, 11 aa, Brucella spp.
GKKPPAHQTGW

SEQ ID NO: 12789 - protein, 5 aa, Brucella spp.
EAARS

SEQ ID NO: 12790 - protein, 4 aa, Brucella spp.
ESTT

SEQ ID NO: 12791 - protein, 10 aa, Brucella spp.
LPTGPGKEVG

SEQ ID NO: 12792 - protein, 5 aa, Brucella spp.
EAPGG

SEQ ID NO: 12793 - protein, 4 aa, Brucella spp.
LTPG

SEQ ID NO: 12794 - protein, 13 aa, Brucella spp.
NPSCAPGEKDGKI

SEQ ID NO: 12795 - protein, 9 aa, Brucella spp.
GGHYDPGNT

SEQ ID NO: 12796 - protein, 11 aa, Brucella spp.
HLGPEGDGHMG

SEQ ID NO: 12797 - protein, 12 aa, Brucella spp.
LSANADGKVSET

SEQ ID NO: 12798 - protein, 24 aa, Brucella spp.
GDNYSDKPEPLGGGGARFACGVIE

SEQ ID NO: 12799 - protein, 11 aa, Brucella spp.
VTGQINPDDVR

SEQ ID NO: 12800 - protein, 13 aa, Brucella spp.
RPDGEGGEEQPDF

SEQ ID NO: 12801 - protein, 4 aa, Brucella spp.
EKAG

SEQ ID NO: 12802 - protein, 9 aa, Brucella spp.
GQLTQENVD

SEQ ID NO: 12803 - protein, 6 aa, Brucella spp.
AEAEGP

SEQ ID NO: 12804 - protein, 7 aa, Brucella spp.
SGARSTN

SEQ ID NO: 12805 - protein, 6 aa, Brucella spp.
YNGTTQ

SEQ ID NO: 12806 - protein, 4 aa, Brucella spp.
PGDL

SEQ ID NO: 12807 - protein, 8 aa, Brucella spp.
KQPEQRLS

SEQ ID NO: 12808 - protein, 5 aa, Brucella spp.
TTFTT

SEQ ID NO: 12809 - protein, 15 aa, Brucella spp.
GAAQALNAKTHATHG

SEQ ID NO: 12810 - protein, 5 aa, Brucella spp.
SAPTA

SEQ ID NO: 12811 - protein, 4 aa, Brucella spp.
AEAA

SEQ ID NO: 12812 - protein, 7 aa, Brucella spp.
AKTGGSV

SEQ ID NO: 12813 - protein, 6 aa, Brucella spp.
LARTGR

SEQ ID NO: 12814 - protein, 5 aa, Brucella spp.
IGTSP

SEQ ID NO: 12815 - protein, 5 aa, Brucella spp.
ASNSL

SEQ ID NO: 12816 - protein, 5 aa, Brucella spp.
TPRNE

SEQ ID NO: 12817 - protein, 4 aa, Brucella spp.
GPPV

SEQ ID NO: 12818 - protein, 4 aa, Brucella spp.
DNEE

SEQ ID NO: 12819 - protein, 5 aa, Brucella spp.
RTPDP

SEQ ID NO: 12820 - protein, 6 aa, Brucella spp.
TFTPAT

SEQ ID NO: 12821 - protein, 13 aa, Brucella spp.
IPNEKTSQATPLT

SEQ ID NO: 12822 - protein, 11 aa, Brucella spp.
APDAGKELATP

SEQ ID NO: 12823 - protein, 10 aa, Brucella spp.
VGPSGGGKST

SEQ ID NO: 12824 - protein, 11 aa, Brucella spp.
TFEPNRKPSWQ

SEQ ID NO: 12825 - protein, 8 aa, Brucella spp.
KNKARERA

SEQ ID NO: 12826 - protein, 14 aa, Brucella spp.
DAWPSTLSGGQQQR

SEQ ID NO: 12827 - protein, 5 aa, Brucella spp.
LAPSP

SEQ ID NO: 12828 - protein, 11 aa, Brucella spp.
EPTSALDPELA

SEQ ID NO: 12829 - protein, 5 aa, Brucella spp.
AQEGT

SEQ ID NO: 12830 - protein, 7 aa, Brucella spp.
VVETGSA

SEQ ID NO: 12831 - protein, 7 aa, Brucella spp.
PTRERTK

SEQ ID NO: 12832 - protein, 11 aa, Brucella spp.
EAPVDPREAGF

SEQ ID NO: 12833 - protein, 11 aa, Brucella spp.
LAEGGSPAMSE

SEQ ID NO: 12834 - protein, 5 aa, Brucella spp.
GLPGL

SEQ ID NO: 12835 - protein, 7 aa, Brucella spp.
HRDREKK

SEQ ID NO: 12836 - protein, 22 aa, Brucella spp.
LLTTGKAAKEKTVKITAKGAEA

SEQ ID NO: 12837 - protein, 13 aa, Brucella spp.
STANARPSEETLS

SEQ ID NO: 12838 - protein, 4 aa, Brucella spp.
RDPA

SEQ ID NO: 12839 - protein, 8 aa, Brucella spp.
KASTDRAT

SEQ ID NO: 12840 - protein, 11 aa, Brucella spp.
EPSTAGTVESA

SEQ ID NO: 12841 - protein, 6 aa, Brucella spp.
SWTTGD

SEQ ID NO: 12842 - protein, 4 aa, Brucella spp.
EDFT

SEQ ID NO: 12843 - protein, 7 aa, Brucella spp.
AKRLPKE

SEQ ID NO: 12844 - protein, 11 aa, Brucella spp.
RESQAAAGLSH

SEQ ID NO: 12845 - protein, 8 aa, Brucella spp.
SPKYPNQT

SEQ ID NO: 12846 - protein, 4 aa, Brucella spp.
SEIA

SEQ ID NO: 12847 - protein, 5 aa, Brucella spp.
AGLPK

SEQ ID NO: 12848 - protein, 6 aa, Brucella spp.
GEGPVV

SEQ ID NO: 12849 - protein, 4 aa, Brucella spp.
SQHP

SEQ ID NO: 12850 - protein, 17 aa, Brucella spp.
GSTRAGTAVSRAAAATV

SEQ ID NO: 12851 - protein, 7 aa, Brucella spp.
LGGKSPN

SEQ ID NO: 12852 - protein, 6 aa, Brucella spp.
LEKAIS

SEQ ID NO: 12853 - protein, 10 aa, Brucella spp.
NTGQSCNAPT

SEQ ID NO: 12854 - protein, 23 aa, Brucella spp.
AKKAAESTKVGDPAQEGDHIGPL

SEQ ID NO: 12855 - protein, 6 aa, Brucella spp.
GIDEGA

SEQ ID NO: 12856 - protein, 15 aa, Brucella spp.
AGGTGRPEGFTEGDY

SEQ ID NO: 12857 - protein, 6 aa, Brucella spp.
NDTPYG

SEQ ID NO: 12858 - protein, 11 aa, Brucella spp.
QTGSPERAKRV

SEQ ID NO: 12859 - protein, 25 aa, Brucella spp.
GTSRAPGSPFGGYKQSGNGREGGKW

SEQ ID NO: 12860 - protein, 16 aa, Brucella spp.
AVDEDSGSNPGDDRDV

SEQ ID NO: 12861 - protein, 7 aa, Brucella spp.
IGNPTRK

SEQ ID NO: 12862 - protein, 6 aa, Brucella spp.
LNEDER

SEQ ID NO: 12863 - protein, 5 aa, Brucella spp.
FSATE

SEQ ID NO: 12864 - protein, 13 aa, Brucella spp.
LSTASERHNGREA

SEQ ID NO: 12865 - protein, 6 aa, Brucella spp.
ELAGAG

SEQ ID NO: 12866 - protein, 8 aa, Brucella spp.
EGENSIGG

SEQ ID NO: 12867 - protein, 6 aa, Brucella spp.
PEQRRL

SEQ ID NO: 12868 - protein, 7 aa, Brucella spp.
FDRPEDH

SEQ ID NO: 12869 - protein, 14 aa, Brucella spp.
ERGGSHAHGHGNSV

SEQ ID NO: 12870 - protein, 5 aa, Brucella spp.
TGPGV

SEQ ID NO: 12871 - protein, 8 aa, Brucella spp.
TTNGRISG

SEQ ID NO: 12872 - protein, 15 aa, Brucella spp.
APSSVERGQPSSREV

SEQ ID NO: 12873 - protein, 10 aa, Brucella spp.
GGIGGDPERV

SEQ ID NO: 12874 - protein, 8 aa, Brucella spp.
RLGNPPED

SEQ ID NO: 12875 - protein, 4 aa, Brucella spp.
VDGR

SEQ ID NO: 12876 - protein, 6 aa, Brucella spp.
GNRLPA

SEQ ID NO: 12877 - protein, 13 aa, Brucella spp.
LSGSEQNPDLTGK

SEQ ID NO: 12878 - protein, 9 aa, Brucella spp.
LGKTPPQPV

SEQ ID NO: 12879 - protein, 14 aa, Brucella spp.
EARDREIANRYSKD

SEQ ID NO: 12880 - protein, 6 aa, Brucella spp.
PANGPL

SEQ ID NO: 12881 - protein, 10 aa, Brucella spp.
DASGKPVPGL

SEQ ID NO: 12882 - protein, 13 aa, Brucella spp.
GEAAGFGGGGYHG

SEQ ID NO: 12883 - protein, 8 aa, Brucella spp.
RGVAEGNK

SEQ ID NO: 12884 - protein, 8 aa, Brucella spp.
TNNETENP

SEQ ID NO: 12885 - protein, 8 aa, Brucella spp.
EKERPDTK

SEQ ID NO: 12886 - protein, 7 aa, Brucella spp.
EDSRDAF

SEQ ID NO: 12887 - protein, 8 aa, Brucella spp.
EPGGYNRD

SEQ ID NO: 12888 - protein, 9 aa, Brucella spp.
AEPDRSRLE

SEQ ID NO: 12889 - protein, 17 aa, Brucella spp.
MSGTYQAGKEGNAIPLS

SEQ ID NO: 12890 - protein, 9 aa, Brucella spp.
SNQPEPENR

SEQ ID NO: 12891 - protein, 8 aa, Brucella spp.
EGESSGHI

SEQ ID NO: 12892 - protein, 9 aa, Brucella spp.
RARKGGLGG

SEQ ID NO: 12893 - protein, 23 aa, Brucella spp.
PSPSHDLDADGNLPTPSQQDTLK

SEQ ID NO: 12894 - protein, 8 aa, Brucella spp.
ERKSEGQV

SEQ ID NO: 12895 - protein, 12 aa, Brucella spp.
SSPDIGPGLTDH

SEQ ID NO: 12896 - protein, 6 aa, Brucella spp.
RNLTDR

SEQ ID NO: 12897 - protein, 6 aa, Brucella spp.
IRDTGG

SEQ ID NO: 12898 - protein, 11 aa, Brucella spp.
EDGKHDPDTKL

SEQ ID NO: 12899 - protein, 6 aa, Brucella spp.
HGYDDA

SEQ ID NO: 12900 - protein, 4 aa, Brucella spp.
QAPV

SEQ ID NO: 12901 - protein, 8 aa, Brucella spp.
GAGREPAD

SEQ ID NO: 12902 - protein, 6 aa, Brucella spp.
SQVTPH

SEQ ID NO: 12903 - protein, 5 aa, Brucella spp.
METSG

SEQ ID NO: 12904 - protein, 4 aa, Brucella spp.
DPEC

SEQ ID NO: 12905 - protein, 13 aa, Brucella spp.
RTEHEATNAEEAL

SEQ ID NO: 12906 - protein, 6 aa, Brucella spp.
GSVSKD

SEQ ID NO: 12907 - protein, 8 aa, Brucella spp.
DDRNPLDI

SEQ ID NO: 12908 - protein, 5 aa, Brucella spp.
APGQR

SEQ ID NO: 12909 - protein, 31 aa, Brucella spp.
PVAEVGRNSVKAPRVTASNFRSQSNSGKTRA

SEQ ID NO: 12910 - protein, 10 aa, Brucella spp.
GPNGVEPDLE

SEQ ID NO: 12911 - protein, 8 aa, Brucella spp.
HGKNGNIA

SEQ ID NO: 12912 - protein, 10 aa, Brucella spp.
AIASTVSHDS

SEQ ID NO: 12913 - protein, 15 aa, Brucella spp.
SDEDIATAANRLGEI

SEQ ID NO: 12914 - protein, 7 aa, Brucella spp.
TEPYETV

SEQ ID NO: 12915 - protein, 5 aa, Brucella spp.
AAEDL

SEQ ID NO: 12916 - protein, 10 aa, Brucella spp.
KAEATARGDN

SEQ ID NO: 12917 - protein, 6 aa, Brucella spp.
KPSNRD

SEQ ID NO: 12918 - protein, 9 aa, Brucella spp.
NDTGAERPW

SEQ ID NO: 12919 - protein, 16 aa, Brucella spp.
QRGEAPQDSRNPQQYT

SEQ ID NO: 12920 - protein, 7 aa, Brucella spp.
RGYAPQF

SEQ ID NO: 12921 - protein, 6 aa, Brucella spp.
WEPTAE

SEQ ID NO: 12922 - protein, 5 aa, Brucella spp.
YSGAE

SEQ ID NO: 12923 - protein, 8 aa, Brucella spp.
KANPRTAN

SEQ ID NO: 12924 - protein, 15 aa, Brucella spp.
SPEDKVRGLEAGAED

SEQ ID NO: 12925 - protein, 4 aa, Brucella spp.
IADA

SEQ ID NO: 12926 - protein, 11 aa, Brucella spp.
MAGKDGNKDEI

SEQ ID NO: 12927 - protein, 6 aa, Brucella spp.
ASDAET

SEQ ID NO: 12928 - protein, 11 aa, Brucella spp.
TITQSVTDGLT

SEQ ID NO: 12929 - protein, 4 aa, Brucella spp.
ERKQ

SEQ ID NO: 12930 - protein, 8 aa, Brucella spp.
EQYGHGAG

SEQ ID NO: 12931 - protein, 6 aa, Brucella spp.
DTDRQA

SEQ ID NO: 12932 - protein, 8 aa, Brucella spp.
DGKRRASL

SEQ ID NO: 12933 - protein, 6 aa, Brucella spp.
RPAGDS

SEQ ID NO: 12934 - protein, 14 aa, Brucella spp.
AKQSGRNRIVLSAA

SEQ ID NO: 12935 - protein, 11 aa, Brucella spp.
EDYTEQRADDL

SEQ ID NO: 12936 - protein, 12 aa, Brucella spp.
GGENESEYGDAA

SEQ ID NO: 12937 - protein, 20 aa, Brucella spp.
RSARTERRAATAQSKDSAAF

SEQ ID NO: 12938 - protein, 12 aa, Brucella spp.
EENPDRAGKREL

SEQ ID NO: 12939 - protein, 4 aa, Brucella spp.
LVEK

SEQ ID NO: 12940 - protein, 12 aa, Brucella spp.
ARKLSRPGSLPS

SEQ ID NO: 12941 - protein, 9 aa, Brucella spp.
TGRDEDGGL

SEQ ID NO: 12942 - protein, 13 aa, Brucella spp.
PAEWDEASHGKPP

SEQ ID NO: 12943 - protein, 11 aa, Brucella spp.
LNKTSESGPVV

SEQ ID NO: 12944 - protein, 9 aa, Brucella spp.
EDHAGPDFS

SEQ ID NO: 12945 - protein, 4 aa, Brucella spp.
GNGE

SEQ ID NO: 12946 - protein, 8 aa, Brucella spp.
NRKQGEVQ

SEQ ID NO: 12947 - protein, 7 aa, Brucella spp.
NAESGDL

SEQ ID NO: 12948 - protein, 6 aa, Brucella spp.
YGLPRG

SEQ ID NO: 12949 - protein, 6 aa, Brucella spp.
IDSEKA

SEQ ID NO: 12950 - protein, 15 aa, Brucella spp.
EAETAGPATLEGRED

SEQ ID NO: 12951 - protein, 25 aa, Brucella spp.
PADAKDHDDAVYAEPDTDPENPGGQ

SEQ ID NO: 12952 - protein, 18 aa, Brucella spp.
VRPGSALDREAQKRGNSV

SEQ ID NO: 12953 - protein, 4 aa, Brucella spp.
EDRP

SEQ ID NO: 12954 - protein, 7 aa, Brucella spp.
DGRKKSH

SEQ ID NO: 12955 - protein, 21 aa, Brucella spp.
VAYGQAQAAIDGAPDDKTGPI

SEQ ID NO: 12956 - protein, 9 aa, Brucella spp.
RGRDAREPL

SEQ ID NO: 12957 - protein, 5 aa, Brucella spp.
TPEGK

SEQ ID NO: 12958 - protein, 10 aa, Brucella spp.
SAAETLEGRH

SEQ ID NO: 12959 - protein, 8 aa, Brucella spp.
PALAKQET

SEQ ID NO: 12960 - protein, 8 aa, Brucella spp.
KGAQLQPA

SEQ ID NO: 12961 - protein, 7 aa, Brucella spp.
DGTDHQE

SEQ ID NO: 12962 - protein, 10 aa, Brucella spp.
QSQAEYSPDN

SEQ ID NO: 12963 - protein, 14 aa, Brucella spp.
GTDGLTSAEEAQLE

SEQ ID NO: 12964 - protein, 4 aa, Brucella spp.
ATER

SEQ ID NO: 12965 - protein, 11 aa, Brucella spp.
GDEYEGRVTGV

SEQ ID NO: 12966 - protein, 11 aa, Brucella spp.
AIAGERSGRGF

SEQ ID NO: 12967 - protein, 5 aa, Brucella spp.
HPLPM

SEQ ID NO: 12968 - protein, 29 aa, Brucella spp.
TRSHHKASRAMRGRKGKPAGIPRHKRRGH

SEQ ID NO: 12969 - protein, 9 aa, Brucella spp.
SPAKAKTIN

SEQ ID NO: 12970 - protein, 13 aa, Brucella spp.
LPAKDGSVRPDED

SEQ ID NO: 12971 - protein, 8 aa, Brucella spp.
DSNSAKRL

SEQ ID NO: 12972 - protein, 4 aa, Brucella spp.
KDSD

SEQ ID NO: 12973 - protein, 9 aa, Brucella spp.
TDPDREGEA

SEQ ID NO: 12974 - protein, 8 aa, Brucella spp.
KALNGKTV

SEQ ID NO: 12975 - protein, 4 aa, Brucella spp.
RDID

SEQ ID NO: 12976 - protein, 10 aa, Brucella spp.
PGARSAGRVQ

SEQ ID NO: 12977 - protein, 9 aa, Brucella spp.
KTPRNDSFT

SEQ ID NO: 12978 - protein, 7 aa, Brucella spp.
DGKKLGK

SEQ ID NO: 12979 - protein, 9 aa, Brucella spp.
IKNGEQAGA

SEQ ID NO: 12980 - protein, 29 aa, Brucella spp.
VEAKPTKRNPGPPFTTSTLQQAASGQLGF

SEQ ID NO: 12981 - protein, 6 aa, Brucella spp.
IGGETA

SEQ ID NO: 12982 - protein, 5 aa, Brucella spp.
NAARD

SEQ ID NO: 12983 - protein, 35 aa, Brucella spp.
KYVPEKPRYYSSKAKNAQEAHEAIRPTDFSRHPKD

SEQ ID NO: 12984 - protein, 6 aa, Brucella spp.
DIERTT

SEQ ID NO: 12985 - protein, 8 aa, Brucella spp.
EATNGSRA

SEQ ID NO: 12986 - protein, 6 aa, Brucella spp.
NGSVTK

SEQ ID NO: 12987 - protein, 42 aa, Brucella spp.
REEEDDDEESAKLPEIRSGEALAREKIDATQHSTEPPPRYSE

SEQ ID NO: 12988 - protein, 9 aa, Brucella spp.
IGRPSTYAA

SEQ ID NO: 12989 - protein, 5 aa, Brucella spp.
IPEAK

SEQ ID NO: 12990 - protein, 4 aa, Brucella spp.
GSVE

SEQ ID NO: 12991 - protein, 17 aa, Brucella spp.
REDGSDPRSCPTCGTGT

SEQ ID NO: 12992 - protein, 37 aa, Brucella spp.
RQLGGEANGETAASDEPKPLGKDPFTGEEITARTGRF

SEQ ID NO: 12993 - protein, 16 aa, Brucella spp.
QRGEGKEAKRASLPKG

SEQ ID NO: 12994 - protein, 7 aa, Brucella spp.
LHPETGK

SEQ ID NO: 12995 - protein, 4 aa, Brucella spp.
RYGP

SEQ ID NO: 12996 - protein, 17 aa, Brucella spp.
DKQSKGGGRGRSTPAAL

SEQ ID NO: 12997 - protein, 11 aa, Brucella spp.
LGDHPDGGAIT

SEQ ID NO: 12998 - protein, 7 aa, Brucella spp.
RDGRYGP

SEQ ID NO: 12999 - protein, 13 aa, Brucella spp.
ATLPKGKDPASVT

SEQ ID NO: 13000 - protein, 47 aa, Brucella spp.
EKAGSSKGRKAPARKSAASSEKKTTAKKTATKKAPAKAKSKAKAAEE

SEQ ID NO: 13001 - protein, 7 aa, Brucella spp.
AKQAQNP

SEQ ID NO: 13002 - protein, 15 aa, Brucella spp.
QEEARDSIEQVTAQD

SEQ ID NO: 13003 - protein, 7 aa, Brucella spp.
RGGSARP

SEQ ID NO: 13004 - protein, 6 aa, Brucella spp.
EAEREL

SEQ ID NO: 13005 - protein, 8 aa, Brucella spp.
EPEYPPQL

SEQ ID NO: 13006 - protein, 6 aa, Brucella spp.
CEAPPP

SEQ ID NO: 13007 - protein, 4 aa, Brucella spp.
PGVF

SEQ ID NO: 13008 - protein, 4 aa, Brucella spp.
RNAS

SEQ ID NO: 13009 - protein, 4 aa, Brucella spp.
DLGS

SEQ ID NO: 13010 - protein, 11 aa, Brucella spp.
AHKASLSTGTA

SEQ ID NO: 13011 - protein, 8 aa, Brucella spp.
DRPYPPEN

SEQ ID NO: 13012 - protein, 5 aa, Brucella spp.
PENGG

SEQ ID NO: 13013 - protein, 11 aa, Brucella spp.
GAEPRSRDFPR

SEQ ID NO: 13014 - protein, 7 aa, Brucella spp.
AERSGSL

SEQ ID NO: 13015 - protein, 12 aa, Brucella spp.
PGSPLDPRARGT

SEQ ID NO: 13016 - protein, 13 aa, Brucella spp.
PADPAGDEPEQPD

SEQ ID NO: 13017 - protein, 7 aa, Brucella spp.
DEEPEQL

SEQ ID NO: 13018 - protein, 7 aa, Brucella spp.
ITTDRER

SEQ ID NO: 13019 - protein, 4 aa, Brucella spp.
GIET

SEQ ID NO: 13020 - protein, 15 aa, Brucella spp.
VSRQPEKKKSVLRGR

SEQ ID NO: 13021 - protein, 8 aa, Brucella spp.
STRTQSSF

SEQ ID NO: 13022 - protein, 11 aa, Brucella spp.
GNSSVKKGETL

SEQ ID NO: 13023 - protein, 6 aa, Brucella spp.
SAGAAA

SEQ ID NO: 13024 - protein, 12 aa, Brucella spp.
NAGDGAHEHPTQ

SEQ ID NO: 13025 - protein, 5 aa, Brucella spp.
AKGQI

SEQ ID NO: 13026 - protein, 5 aa, Brucella spp.
EGLKD

SEQ ID NO: 13027 - protein, 9 aa, Brucella spp.
DVADGPQSV

SEQ ID NO: 13028 - protein, 8 aa, Brucella spp.
PITGTNAY

SEQ ID NO: 13029 - protein, 4 aa, Brucella spp.
AQDL

SEQ ID NO: 13030 - protein, 4 aa, Brucella spp.
NTEL

SEQ ID NO: 13031 - protein, 9 aa, Brucella spp.
RTHDRQGRR

SEQ ID NO: 13032 - protein, 12 aa, Brucella spp.
NPLESGRRHQAR

SEQ ID NO: 13033 - protein, 9 aa, Brucella spp.
SQKPAFRKQ

SEQ ID NO: 13034 - protein, 21 aa, Brucella spp.
TEKQGGTDVRANATRAEPAIG

SEQ ID NO: 13035 - protein, 5 aa, Brucella spp.
QTKEG

SEQ ID NO: 13036 - protein, 8 aa, Brucella spp.
GEKGESNG

SEQ ID NO: 13037 - protein, 14 aa, Brucella spp.
KLGNRSNASSEVEF

SEQ ID NO: 13038 - protein, 8 aa, Brucella spp.
GSPGEGVK

SEQ ID NO: 13039 - protein, 8 aa, Brucella spp.
ASDRAEAA

SEQ ID NO: 13040 - protein, 6 aa, Brucella spp.
GYIEDG

SEQ ID NO: 13041 - protein, 5 aa, Brucella spp.
AYREA

SEQ ID NO: 13042 - protein, 9 aa, Brucella spp.
QLGPRGQGT

SEQ ID NO: 13043 - protein, 7 aa, Brucella spp.
TETDQGV

SEQ ID NO: 13044 - protein, 9 aa, Brucella spp.
NGNPGAKGI

SEQ ID NO: 13045 - protein, 7 aa, Brucella spp.
KEATRGV

SEQ ID NO: 13046 - protein, 6 aa, Brucella spp.
HGDHVG

SEQ ID NO: 13047 - protein, 17 aa, Brucella spp.
SQGVEKLDPGNTGGTLA

SEQ ID NO: 13048 - protein, 12 aa, Brucella spp.
ENGVSQALGNPN

SEQ ID NO: 13049 - protein, 6 aa, Brucella spp.
DHPATK

SEQ ID NO: 13050 - protein, 12 aa, Brucella spp.
ADPAGTVHSFQA

SEQ ID NO: 13051 - protein, 10 aa, Brucella spp.
SEDDAERMTG

SEQ ID NO: 13052 - protein, 8 aa, Brucella spp.
DKVTDGGI

SEQ ID NO: 13053 - protein, 6 aa, Brucella spp.
NAPVTE

SEQ ID NO: 13054 - protein, 15 aa, Brucella spp.
ARDKLKAKAITATEL

SEQ ID NO: 13055 - protein, 6 aa, Brucella spp.
AANDAI

SEQ ID NO: 13056 - protein, 22 aa, Brucella spp.
DQARSMAKASDERIAKGEAGAL

SEQ ID NO: 13057 - protein, 8 aa, Brucella spp.
KPEYESTV

SEQ ID NO: 13058 - protein, 11 aa, Brucella spp.
GSSNETSYYGP

SEQ ID NO: 13059 - protein, 25 aa, Brucella spp.
KNPWRAKGSNADLVPGGSSGGSAAA

SEQ ID NO: 13060 - protein, 16 aa, Brucella spp.
ATATDTGGSIRQPAAF

SEQ ID NO: 13061 - protein, 6 aa, Brucella spp.
KPTYGR

SEQ ID NO: 13062 - protein, 11 aa, Brucella spp.
SLDQAGPIARD

SEQ ID NO: 13063 - protein, 7 aa, Brucella spp.
LKDTTSV

SEQ ID NO: 13064 - protein, 5 aa, Brucella spp.
LGRSV

SEQ ID NO: 13065 - protein, 4 aa, Brucella spp.
GMPG

SEQ ID NO: 13066 - protein, 9 aa, Brucella spp.
AEASSNLAR

SEQ ID NO: 13067 - protein, 9 aa, Brucella spp.
TRAAGFGKE

SEQ ID NO: 13068 - protein, 8 aa, Brucella spp.
TPATPSAA

SEQ ID NO: 13069 - protein, 8 aa, Brucella spp.
AGLNGQGL

SEQ ID NO: 13070 - protein, 31 aa, Brucella spp.
VQPAPSAPKPVPAAAKAPPAASGGDDYNASS

SEQ ID NO: 13071 - protein, 6 aa, Brucella spp.
GGTDEK

SEQ ID NO: 13072 - protein, 5 aa, Brucella spp.
MDEAV

SEQ ID NO: 13073 - protein, 9 aa, Brucella spp.
SDNGRGIPV

SEQ ID NO: 13074 - protein, 9 aa, Brucella spp.
HPQVPGKST

SEQ ID NO: 13075 - protein, 15 aa, Brucella spp.
GGKFDGKAYETSGGL

SEQ ID NO: 13076 - protein, 8 aa, Brucella spp.
GIPQGGLE

SEQ ID NO: 13077 - protein, 6 aa, Brucella spp.
HNRRGT

SEQ ID NO: 13078 - protein, 10 aa, Brucella spp.
LDPKKETPEK

SEQ ID NO: 13079 - protein, 6 aa, Brucella spp.
GKEHQV

SEQ ID NO: 13080 - protein, 11 aa, Brucella spp.
GRTEKQGGHGA

SEQ ID NO: 13081 - protein, 11 aa, Brucella spp.
IPTGDGGTHEA

SEQ ID NO: 13082 - protein, 12 aa, Brucella spp.
AELTNNKRASII

SEQ ID NO: 13083 - protein, 10 aa, Brucella spp.
GQTKDKLATV

SEQ ID NO: 13084 - protein, 6 aa, Brucella spp.
SPQEAS

SEQ ID NO: 13085 - protein, 21 aa, Brucella spp.
DERLRRRQEKETVRKSATRKL

SEQ ID NO: 13086 - protein, 9 aa, Brucella spp.
DCTQNAAAG

SEQ ID NO: 13087 - protein, 15 aa, Brucella spp.
DSAGGSAKQARNRAN

SEQ ID NO: 13088 - protein, 13 aa, Brucella spp.
ASAGREKLTANQQ

SEQ ID NO: 13089 - protein, 11 aa, Brucella spp.
GTRKNYREDDL

SEQ ID NO: 13090 - protein, 4 aa, Brucella spp.
VDGA

SEQ ID NO: 13091 - protein, 17 aa, Brucella spp.
SQGGKTAYARDDAHKEE

SEQ ID NO: 13092 - protein, 10 aa, Brucella spp.
LKETTMDPAK

SEQ ID NO: 13093 - protein, 11 aa, Brucella spp.
EEYGDETRNTV

SEQ ID NO: 13094 - protein, 6 aa, Brucella spp.
GTKPEA

SEQ ID NO: 13095 - protein, 6 aa, Brucella spp.
LPPATA

SEQ ID NO: 13096 - protein, 8 aa, Brucella spp.
YGAKESPL

SEQ ID NO: 13097 - protein, 6 aa, Brucella spp.
KLAPAS

SEQ ID NO: 13098 - protein, 5 aa, Brucella spp.
PTPSK

SEQ ID NO: 13099 - protein, 14 aa, Brucella spp.
SPVTPSTETQQPKR

SEQ ID NO: 13100 - protein, 8 aa, Brucella spp.
QEADAPPV

SEQ ID NO: 13101 - protein, 7 aa, Brucella spp.
IREGTAS

SEQ ID NO: 13102 - protein, 12 aa, Brucella spp.
YTAGTSANAEDL

SEQ ID NO: 13103 - protein, 14 aa, Brucella spp.
TGRGGEYTYHGPGQ

SEQ ID NO: 13104 - protein, 5 aa, Brucella spp.
RRRED

SEQ ID NO: 13105 - protein, 8 aa, Brucella spp.
KGERREDR

SEQ ID NO: 13106 - protein, 9 aa, Brucella spp.
EKPRLADGS

SEQ ID NO: 13107 - protein, 7 aa, Brucella spp.
HGTDPAH

SEQ ID NO: 13108 - protein, 5 aa, Brucella spp.
AAEKP

SEQ ID NO: 13109 - protein, 6 aa, Brucella spp.
KKSGEA

SEQ ID NO: 13110 - protein, 4 aa, Brucella spp.
NANG

SEQ ID NO: 13111 - protein, 16 aa, Brucella spp.
KERKTLSIETARSKDQ

SEQ ID NO: 13112 - protein, 4 aa, Brucella spp.
PDEP

SEQ ID NO: 13113 - protein, 8 aa, Brucella spp.
QAVTGEPY

SEQ ID NO: 13114 - protein, 7 aa, Brucella spp.
KALTGEN

SEQ ID NO: 13115 - protein, 12 aa, Brucella spp.
VTERKKAEANKA

SEQ ID NO: 13116 - protein, 13 aa, Brucella spp.
QTLRNTYDPEQAN

SEQ ID NO: 13117 - protein, 8 aa, Brucella spp.
GALSNEKG

SEQ ID NO: 13118 - protein, 6 aa, Brucella spp.
DKGEKK

SEQ ID NO: 13119 - protein, 7 aa, Brucella spp.
SRGPEVM

SEQ ID NO: 13120 - protein, 5 aa, Brucella spp.
ARRGF

SEQ ID NO: 13121 - protein, 5 aa, Brucella spp.
KGDPV

SEQ ID NO: 13122 - protein, 10 aa, Brucella spp.
EKGIGDQERS

SEQ ID NO: 13123 - protein, 8 aa, Brucella spp.
DKEDGECN

SEQ ID NO: 13124 - protein, 5 aa, Brucella spp.
GQGAT

SEQ ID NO: 13125 - protein, 12 aa, Brucella spp.
AAASDSPDATIA

SEQ ID NO: 13126 - protein, 28 aa, Brucella spp.
LDPTPARTRLPSCTEKAEAIKGPDGGFT

SEQ ID NO: 13127 - protein, 4 aa, Brucella spp.
ALPA

SEQ ID NO: 13128 - protein, 16 aa, Brucella spp.
SPPGSPVNNPVEARRK

SEQ ID NO: 13129 - protein, 5 aa, Brucella spp.
APDFS

SEQ ID NO: 13130 - protein, 8 aa, Brucella spp.
DQDAKNEA

SEQ ID NO: 13131 - protein, 8 aa, Brucella spp.
PAKGGNAD

SEQ ID NO: 13132 - protein, 7 aa, Brucella spp.
GDGGWRD

SEQ ID NO: 13133 - protein, 12 aa, Brucella spp.
RTPEEIANDTTA

SEQ ID NO: 13134 - protein, 8 aa, Brucella spp.
KADPTGKL

SEQ ID NO: 13135 - protein, 7 aa, Brucella spp.
PSIQDRT

SEQ ID NO: 13136 - protein, 4 aa, Brucella spp.
TTTT

SEQ ID NO: 13137 - protein, 6 aa, Brucella spp.
GDKDVV

SEQ ID NO: 13138 - protein, 14 aa, Brucella spp.
QEEDDTACTADELK

SEQ ID NO: 13139 - protein, 17 aa, Brucella spp.
RADASKATAKPSARRSL

SEQ ID NO: 13140 - protein, 6 aa, Brucella spp.
AGASSI

SEQ ID NO: 13141 - protein, 11 aa, Brucella spp.
QARNAPASPLG

SEQ ID NO: 13142 - protein, 9 aa, Brucella spp.
GGSSTVGEG

SEQ ID NO: 13143 - protein, 6 aa, Brucella spp.
LSGIGP

SEQ ID NO: 13144 - protein, 10 aa, Brucella spp.
TDVPGGEPKI

SEQ ID NO: 13145 - protein, 7 aa, Brucella spp.
RRNRPGI

SEQ ID NO: 13146 - protein, 13 aa, Brucella spp.
QHQPAPKGRGNVP

SEQ ID NO: 13147 - protein, 5 aa, Brucella spp.
DDTGE

SEQ ID NO: 13148 - protein, 9 aa, Brucella spp.
GLSPKTLGR

SEQ ID NO: 13149 - protein, 9 aa, Brucella spp.
HQPEDPGDI

SEQ ID NO: 13150 - protein, 14 aa, Brucella spp.
TRRLSGRPLEGTGN

SEQ ID NO: 13151 - protein, 6 aa, Brucella spp.
KAQEQA

SEQ ID NO: 13152 - protein, 5 aa, Brucella spp.
KSPQR

SEQ ID NO: 13153 - protein, 7 aa, Brucella spp.
DVGSGKT

SEQ ID NO: 13154 - protein, 9 aa, Brucella spp.
AAESGGQSA

SEQ ID NO: 13155 - protein, 7 aa, Brucella spp.
LAEKAGL

SEQ ID NO: 13156 - protein, 11 aa, Brucella spp.
TGREKGRERNA

SEQ ID NO: 13157 - protein, 4 aa, Brucella spp.
KSGE

SEQ ID NO: 13158 - protein, 6 aa, Brucella spp.
KGSAPD

SEQ ID NO: 13159 - protein, 11 aa, Brucella spp.
LTEKPVGRQPI

SEQ ID NO: 13160 - protein, 6 aa, Brucella spp.
AVSEDQ

SEQ ID NO: 13161 - protein, 7 aa, Brucella spp.
SAEERFE

SEQ ID NO: 13162 - protein, 10 aa, Brucella spp.
MSGAEKDEAM

SEQ ID NO: 13163 - protein, 5 aa, Brucella spp.
KQGET

SEQ ID NO: 13164 - protein, 10 aa, Brucella spp.
RVGRGDKPST

SEQ ID NO: 13165 - protein, 4 aa, Brucella spp.
LGEI

SEQ ID NO: 13166 - protein, 5 aa, Brucella spp.
ETEDG

SEQ ID NO: 13167 - protein, 7 aa, Brucella spp.
LRGEGEL

SEQ ID NO: 13168 - protein, 11 aa, Brucella spp.
LGTRQSGTPGF

SEQ ID NO: 13169 - protein, 11 aa, Brucella spp.
DPDLESERGQA

SEQ ID NO: 13170 - protein, 7 aa, Brucella spp.
GAIANKG

SEQ ID NO: 13171 - protein, 4 aa, Brucella spp.
IGER

SEQ ID NO: 13172 - protein, 11 aa, Brucella spp.
VSPGADAAARR

SEQ ID NO: 13173 - protein, 5 aa, Brucella spp.
KAPHP

SEQ ID NO: 13174 - protein, 7 aa, Brucella spp.
LPPQAAL

SEQ ID NO: 13175 - protein, 8 aa, Brucella spp.
SARPGNQL

SEQ ID NO: 13176 - protein, 4 aa, Brucella spp.
ERNG

SEQ ID NO: 13177 - protein, 6 aa, Brucella spp.
PGAEEP

SEQ ID NO: 13178 - protein, 12 aa, Brucella spp.
DPASQRTTGTRK

SEQ ID NO: 13179 - protein, 7 aa, Brucella spp.
APQRDDA

SEQ ID NO: 13180 - protein, 4 aa, Brucella spp.
EGRR

SEQ ID NO: 13181 - protein, 18 aa, Brucella spp.
RQAEGKEAGSDAVPYKPV

SEQ ID NO: 13182 - protein, 11 aa, Brucella spp.
GQVEEAAEAAG

SEQ ID NO: 13183 - protein, 8 aa, Brucella spp.
GAPEVSGR

SEQ ID NO: 13184 - protein, 13 aa, Brucella spp.
KGRSFAEERAATD

SEQ ID NO: 13185 - protein, 5 aa, Brucella spp.
RASGK

SEQ ID NO: 13186 - protein, 6 aa, Brucella spp.
LSRDKV

SEQ ID NO: 13187 - protein, 5 aa, Brucella spp.
SGFDA

SEQ ID NO: 13188 - protein, 10 aa, Brucella spp.
RSRRRKRDQD

SEQ ID NO: 13189 - protein, 7 aa, Brucella spp.
TAAGAPH

SEQ ID NO: 13190 - protein, 9 aa, Brucella spp.
YGSEGSDAV

SEQ ID NO: 13191 - protein, 12 aa, Brucella spp.
GGGAWQARKAKL

SEQ ID NO: 13192 - protein, 4 aa, Brucella spp.
RQMR

SEQ ID NO: 13193 - protein, 6 aa, Brucella spp.
MTPPGG

SEQ ID NO: 13194 - protein, 10 aa, Brucella spp.
PYDETDDQLT

SEQ ID NO: 13195 - protein, 8 aa, Brucella spp.
DLAQGKPM

SEQ ID NO: 13196 - protein, 13 aa, Brucella spp.
ELAATKKGLEEGT

SEQ ID NO: 13197 - protein, 5 aa, Brucella spp.
TPIPR

SEQ ID NO: 13198 - protein, 4 aa, Brucella spp.
TPPV

SEQ ID NO: 13199 - protein, 6 aa, Brucella spp.
RYRGGQ

SEQ ID NO: 13200 - protein, 5 aa, Brucella spp.
DIPTA

SEQ ID NO: 13201 - protein, 8 aa, Brucella spp.
RVGRSKQR

SEQ ID NO: 13202 - protein, 10 aa, Brucella spp.
LLGEEQSGHI

SEQ ID NO: 13203 - protein, 16 aa, Brucella spp.
TLKGSGEVEDSQWSPQ

SEQ ID NO: 13204 - protein, 7 aa, Brucella spp.
LEEPQDI

SEQ ID NO: 13205 - protein, 8 aa, Brucella spp.
KLDAGPKG

SEQ ID NO: 13206 - protein, 4 aa, Brucella spp.
EQGS

SEQ ID NO: 13207 - protein, 5 aa, Brucella spp.
KIRPD

SEQ ID NO: 13208 - protein, 9 aa, Brucella spp.
PTPEKRLNG

SEQ ID NO: 13209 - protein, 9 aa, Brucella spp.
YDSGAETFS

SEQ ID NO: 13210 - protein, 9 aa, Brucella spp.
GEPLPTRTN

SEQ ID NO: 13211 - protein, 4 aa, Brucella spp.
NEYE

SEQ ID NO: 13212 - protein, 12 aa, Brucella spp.
REGRSRVPGEGQ

SEQ ID NO: 13213 - protein, 13 aa, Brucella spp.
TLDERLKRYGQGR

SEQ ID NO: 13214 - protein, 4 aa, Brucella spp.
LPDV

SEQ ID NO: 13215 - protein, 12 aa, Brucella spp.
TLPPHGKDRQTY

SEQ ID NO: 13216 - protein, 12 aa, Brucella spp.
FGTGSKIDDSHR

SEQ ID NO: 13217 - protein, 4 aa, Brucella spp.
PNTL

SEQ ID NO: 13218 - protein, 9 aa, Brucella spp.
QAAPDTQDR

SEQ ID NO: 13219 - protein, 6 aa, Brucella spp.
GQDIGN

SEQ ID NO: 13220 - protein, 4 aa, Brucella spp.
SVSM

SEQ ID NO: 13221 - protein, 11 aa, Brucella spp.
SEADKDTIRDE

SEQ ID NO: 13222 - protein, 6 aa, Brucella spp.
AQTPDV

SEQ ID NO: 13223 - protein, 15 aa, Brucella spp.
RQTAEGFEPGIAEDR

SEQ ID NO: 13224 - protein, 19 aa, Brucella spp.
KTKLTGKLKAKKVTAPQAK

SEQ ID NO: 13225 - protein, 6 aa, Brucella spp.
ASDGRY

SEQ ID NO: 13226 - protein, 4 aa, Brucella spp.
GPIA

SEQ ID NO: 13227 - protein, 6 aa, Brucella spp.
TGMKTK

SEQ ID NO: 13228 - protein, 5 aa, Brucella spp.
EAALA

SEQ ID NO: 13229 - protein, 6 aa, Brucella spp.
AHAEEK

SEQ ID NO: 13230 - protein, 5 aa, Brucella spp.
PPGDF

SEQ ID NO: 13231 - protein, 5 aa, Brucella spp.
DQARK

SEQ ID NO: 13232 - protein, 10 aa, Brucella spp.
AEGADAERSI

SEQ ID NO: 13233 - protein, 12 aa, Brucella spp.
ATGYKTADNMSA

SEQ ID NO: 13234 - protein, 8 aa, Brucella spp.
MSKKGIAG

SEQ ID NO: 13235 - protein, 5 aa, Brucella spp.
SVNPD

SEQ ID NO: 13236 - protein, 10 aa, Brucella spp.
PGKEADAAKA

SEQ ID NO: 13237 - protein, 8 aa, Brucella spp.
QHTDSTAA

SEQ ID NO: 13238 - protein, 5 aa, Brucella spp.
PDTQL

SEQ ID NO: 13239 - protein, 4 aa, Brucella spp.
NMPD

SEQ ID NO: 13240 - protein, 30 aa, Brucella spp.
KLAEETEARIKSGELNPFTGPIKKQDGSEW

SEQ ID NO: 13241 - protein, 9 aa, Brucella spp.
AGEKADDQT

SEQ ID NO: 13242 - protein, 13 aa, Brucella spp.
SEGYEISRKHDGA

SEQ ID NO: 13243 - protein, 7 aa, Brucella spp.
ARDESLE

SEQ ID NO: 13244 - protein, 4 aa, Brucella spp.
AEPD

SEQ ID NO: 13245 - protein, 7 aa, Brucella spp.
TGPQAYE

SEQ ID NO: 13246 - protein, 6 aa, Brucella spp.
APPAHD

SEQ ID NO: 13247 - protein, 4 aa, Brucella spp.
PQGV

SEQ ID NO: 13248 - protein, 5 aa, Brucella spp.
EGCSN

SEQ ID NO: 13249 - protein, 6 aa, Brucella spp.
DTSAYG

SEQ ID NO: 13250 - protein, 12 aa, Brucella spp.
RPAHQEKTSRRI

SEQ ID NO: 13251 - protein, 7 aa, Brucella spp.
PGETEED

SEQ ID NO: 13252 - protein, 9 aa, Brucella spp.
KGAKANDLG

SEQ ID NO: 13253 - protein, 7 aa, Brucella spp.
QVPEEVK

SEQ ID NO: 13254 - protein, 5 aa, Brucella spp.
QQIST

SEQ ID NO: 13255 - protein, 18 aa, Brucella spp.
ANGTIGKGRTRYDAPEID

SEQ ID NO: 13256 - protein, 5 aa, Brucella spp.
SRRPL

SEQ ID NO: 13257 - protein, 12 aa, Brucella spp.
ASDAYDLHGTAV

SEQ ID NO: 13258 - protein, 8 aa, Brucella spp.
KKEREESI

SEQ ID NO: 13259 - protein, 16 aa, Brucella spp.
LKGEYDARASYKESRE

SEQ ID NO: 13260 - protein, 17 aa, Brucella spp.
GEERYGQLNAAPADEAE

SEQ ID NO: 13261 - protein, 7 aa, Brucella spp.
DGKLSRI

SEQ ID NO: 13262 - protein, 16 aa, Brucella spp.
VRGRNGGVRLGRASQD

SEQ ID NO: 13263 - protein, 5 aa, Brucella spp.
DASEC

SEQ ID NO: 13264 - protein, 4 aa, Brucella spp.
APEV

SEQ ID NO: 13265 - protein, 8 aa, Brucella spp.
PTSTATVP

SEQ ID NO: 13266 - protein, 8 aa, Brucella spp.
HGVEPGQI

SEQ ID NO: 13267 - protein, 6 aa, Brucella spp.
SFSTKD

SEQ ID NO: 13268 - protein, 7 aa, Brucella spp.
DARIDNR

SEQ ID NO: 13269 - protein, 9 aa, Brucella spp.
KDRFGTKPR

SEQ ID NO: 13270 - protein, 6 aa, Brucella spp.
ETSHPV

SEQ ID NO: 13271 - protein, 10 aa, Brucella spp.
PAAGATNSAV

SEQ ID NO: 13272 - protein, 11 aa, Brucella spp.
AAGAAPGTEAD

SEQ ID NO: 13273 - protein, 5 aa, Brucella spp.
APMSA

SEQ ID NO: 13274 - protein, 7 aa, Brucella spp.
GGGYFST

SEQ ID NO: 13275 - protein, 10 aa, Brucella spp.
TRKGTARSFA

SEQ ID NO: 13276 - protein, 4 aa, Brucella spp.
TDGG

SEQ ID NO: 13277 - protein, 9 aa, Brucella spp.
SNAGGGSGA

SEQ ID NO: 13278 - protein, 6 aa, Brucella spp.
KPNLGG

SEQ ID NO: 13279 - protein, 21 aa, Brucella spp.
PVQKDDEARKLLRGDRIRQGR

SEQ ID NO: 13280 - protein, 9 aa, Brucella spp.
DAYARERGR

SEQ ID NO: 13281 - protein, 4 aa, Brucella spp.
VGPE

SEQ ID NO: 13282 - protein, 6 aa, Brucella spp.
GRYDSN

SEQ ID NO: 13283 - protein, 8 aa, Brucella spp.
AAKLKSPV

SEQ ID NO: 13284 - protein, 7 aa, Brucella spp.
MEDDAGQ

SEQ ID NO: 13285 - protein, 5 aa, Brucella spp.
SLPSA

SEQ ID NO: 13286 - protein, 14 aa, Brucella spp.
PKGEEGLEAYYPGD

SEQ ID NO: 13287 - protein, 5 aa, Brucella spp.
GRDTT

SEQ ID NO: 13288 - protein, 9 aa, Brucella spp.
ERTKPGYDR

SEQ ID NO: 13289 - protein, 8 aa, Brucella spp.
GYEGDDDY

SEQ ID NO: 13290 - protein, 10 aa, Brucella spp.
AEANKPHAEF

SEQ ID NO: 13291 - protein, 14 aa, Brucella spp.
VGRPDWRVANHPLD

SEQ ID NO: 13292 - protein, 6 aa, Brucella spp.
DKNARK

SEQ ID NO: 13293 - protein, 4 aa, Brucella spp.
CAEG

SEQ ID NO: 13294 - protein, 10 aa, Brucella spp.
TPPRAGHGDA

SEQ ID NO: 13295 - protein, 8 aa, Brucella spp.
TVPVGTGD

SEQ ID NO: 13296 - protein, 14 aa, Brucella spp.
RRAGTFSVASNPEF

SEQ ID NO: 13297 - protein, 7 aa, Brucella spp.
EDERARK

SEQ ID NO: 13298 - protein, 9 aa, Brucella spp.
TPLKEQKTP

SEQ ID NO: 13299 - protein, 5 aa, Brucella spp.
RRTSE

SEQ ID NO: 13300 - protein, 9 aa, Brucella spp.
AGPGYGGSC

SEQ ID NO: 13301 - protein, 10 aa, Brucella spp.
VTANEARKRR

SEQ ID NO: 13302 - protein, 5 aa, Brucella spp.
GGDVE

SEQ ID NO: 13303 - protein, 13 aa, Brucella spp.
KPDTDDMRDAPSV

SEQ ID NO: 13304 - protein, 11 aa, Brucella spp.
DPIGAENARNI

SEQ ID NO: 13305 - protein, 7 aa, Brucella spp.
AYEPNVA

SEQ ID NO: 13306 - protein, 13 aa, Brucella spp.
GRAATARHETSIK

SEQ ID NO: 13307 - protein, 22 aa, Brucella spp.
SRSRRADSAEELVPEGGGSNDL

SEQ ID NO: 13308 - protein, 18 aa, Brucella spp.
VRPNTTATIDEGKRSAET

SEQ ID NO: 13309 - protein, 10 aa, Brucella spp.
GPRMRPDDGR

SEQ ID NO: 13310 - protein, 5 aa, Brucella spp.
GEDIT

SEQ ID NO: 13311 - protein, 9 aa, Brucella spp.
YGDGSQTRS

SEQ ID NO: 13312 - protein, 6 aa, Brucella spp.
GNPGEF

SEQ ID NO: 13313 - protein, 4 aa, Brucella spp.
GSRS

SEQ ID NO: 13314 - protein, 11 aa, Brucella spp.
DDPRQRRPDIT

SEQ ID NO: 13315 - protein, 4 aa, Brucella spp.
GLEP

SEQ ID NO: 13316 - protein, 22 aa, Brucella spp.
QAQDWRPQHGQHKVEPRRPMPP

SEQ ID NO: 13317 - protein, 22 aa, Brucella spp.
ERNDRRDYGKHNRWSKGQRYND

SEQ ID NO: 13318 - protein, 9 aa, Brucella spp.
LRAPARGQR

SEQ ID NO: 13319 - protein, 13 aa, Brucella spp.
PTGERNAITDVPG

SEQ ID NO: 13320 - protein, 7 aa, Brucella spp.
DGNINTG

SEQ ID NO: 13321 - protein, 5 aa, Brucella spp.
GKSTG

SEQ ID NO: 13322 - protein, 13 aa, Brucella spp.
AANPDIGRATATV

SEQ ID NO: 13323 - protein, 7 aa, Brucella spp.
NDGPLND

SEQ ID NO: 13324 - protein, 13 aa, Brucella spp.
VNVPQGNVGAGTG

SEQ ID NO: 13325 - protein, 9 aa, Brucella spp.
GIGTSSRRF

SEQ ID NO: 13326 - protein, 18 aa, Brucella spp.
PDGRRPSPKAETQPEKGS

SEQ ID NO: 13327 - protein, 4 aa, Brucella spp.
GSGD

SEQ ID NO: 13328 - protein, 7 aa, Brucella spp.
DHDEPND

SEQ ID NO: 13329 - protein, 7 aa, Brucella spp.
AEATEEA

SEQ ID NO: 13330 - protein, 18 aa, Brucella spp.
MRGRAGNRRRSLADWLSH

SEQ ID NO: 13331 - protein, 14 aa, Brucella spp.
AKSPLGITTQNPAI

SEQ ID NO: 13332 - protein, 7 aa, Brucella spp.
ARFQDGK

SEQ ID NO: 13333 - protein, 9 aa, Brucella spp.
DTDTGRQTI

SEQ ID NO: 13334 - protein, 5 aa, Brucella spp.
SSTEA

SEQ ID NO: 13335 - protein, 28 aa, Brucella spp.
TGTSAKGLSADGKALEIRTQDGAVKAIE

SEQ ID NO: 13336 - protein, 10 aa, Brucella spp.
GRKPQTDGWG

SEQ ID NO: 13337 - protein, 4 aa, Brucella spp.
CRTS

SEQ ID NO: 13338 - protein, 5 aa, Brucella spp.
VTGEP

SEQ ID NO: 13339 - protein, 8 aa, Brucella spp.
QKKYGKER

SEQ ID NO: 13340 - protein, 17 aa, Brucella spp.
SGGGIYGGQTHSQSPEA

SEQ ID NO: 13341 - protein, 9 aa, Brucella spp.
MPSTPADAK

SEQ ID NO: 13342 - protein, 4 aa, Brucella spp.
EDPD

SEQ ID NO: 13343 - protein, 16 aa, Brucella spp.
YNGPFDGHHDKPVTSW

SEQ ID NO: 13344 - protein, 8 aa, Brucella spp.
DLGEVPEG

SEQ ID NO: 13345 - protein, 9 aa, Brucella spp.
AIRREGSDV

SEQ ID NO: 13346 - protein, 8 aa, Brucella spp.
AEETGVDA

SEQ ID NO: 13347 - protein, 4 aa, Brucella spp.
KKTG

SEQ ID NO: 13348 - protein, 7 aa, Brucella spp.
GTPYPHA

SEQ ID NO: 13349 - protein, 16 aa, Brucella spp.
PGPDRVGRALVSIMEA

SEQ ID NO: 13350 - protein, 6 aa, Brucella spp.
LGNMGR

SEQ ID NO: 13351 - protein, 7 aa, Brucella spp.
KVPVPDE

SEQ ID NO: 13352 - protein, 7 aa, Brucella spp.
YSESHAE

SEQ ID NO: 13353 - protein, 7 aa, Brucella spp.
ATTVEDA

SEQ ID NO: 13354 - protein, 5 aa, Brucella spp.
RANGR

SEQ ID NO: 13355 - protein, 5 aa, Brucella spp.
RKLGG

SEQ ID NO: 13356 - protein, 11 aa, Brucella spp.
NQQSSGATWET

SEQ ID NO: 13357 - protein, 5 aa, Brucella spp.
ARPVE

SEQ ID NO: 13358 - protein, 5 aa, Brucella spp.
EIKPD

SEQ ID NO: 13359 - protein, 4 aa, Brucella spp.
SPNG

SEQ ID NO: 13360 - protein, 14 aa, Brucella spp.
VTKSDDVDAHTKTA

SEQ ID NO: 13361 - protein, 8 aa, Brucella spp.
AERDADGR

SEQ ID NO: 13362 - protein, 11 aa, Brucella spp.
SMADEPGHQEL

SEQ ID NO: 13363 - protein, 5 aa, Brucella spp.
FPTPE

SEQ ID NO: 13364 - protein, 12 aa, Brucella spp.
DDLKNAGRIDGM

SEQ ID NO: 13365 - protein, 9 aa, Brucella spp.
PSEATKTVT

SEQ ID NO: 13366 - protein, 4 aa, Brucella spp.
DPNW

SEQ ID NO: 13367 - protein, 4 aa, Brucella spp.
CDGI

SEQ ID NO: 13368 - protein, 10 aa, Brucella spp.
ALAGPDKATD

SEQ ID NO: 13369 - protein, 7 aa, Brucella spp.
GNPSMGA

SEQ ID NO: 13370 - protein, 9 aa, Brucella spp.
SKRDGETWR

SEQ ID NO: 13371 - protein, 6 aa, Brucella spp.
ARAYGS

SEQ ID NO: 13372 - protein, 10 aa, Brucella spp.
DGPSNPLQKT

SEQ ID NO: 13373 - protein, 5 aa, Brucella spp.
RGGRE

SEQ ID NO: 13374 - protein, 8 aa, Brucella spp.
SIDPQSSL

SEQ ID NO: 13375 - protein, 7 aa, Brucella spp.
DSSSSHQ

SEQ ID NO: 13376 - protein, 5 aa, Brucella spp.
AAGSN

SEQ ID NO: 13377 - protein, 8 aa, Brucella spp.
GSAFNPET

SEQ ID NO: 13378 - protein, 5 aa, Brucella spp.
AGYAT

SEQ ID NO: 13379 - protein, 10 aa, Brucella spp.
DESGYLTNEH

SEQ ID NO: 13380 - protein, 7 aa, Brucella spp.
TEPAPAS

SEQ ID NO: 13381 - protein, 7 aa, Brucella spp.
DQEARET

SEQ ID NO: 13382 - protein, 7 aa, Brucella spp.
SLTTPIE

SEQ ID NO: 13383 - protein, 5 aa, Brucella spp.
AEKHI

SEQ ID NO: 13384 - protein, 22 aa, Brucella spp.
RAAGGTNAVSQEVRDAFADNSQ

SEQ ID NO: 13385 - protein, 11 aa, Brucella spp.
DDPRNATDEQI

SEQ ID NO: 13386 - protein, 8 aa, Brucella spp.
AANDTVPG

SEQ ID NO: 13387 - protein, 4 aa, Brucella spp.
NLGA

SEQ ID NO: 13388 - protein, 23 aa, Brucella spp.
KAGPEPDSKPEAMLAPASIAPAE

SEQ ID NO: 13389 - protein, 5 aa, Brucella spp.
GLSAA

SEQ ID NO: 13390 - protein, 6 aa, Brucella spp.
AQPSAA

SEQ ID NO: 13391 - protein, 16 aa, Brucella spp.
SEPAMRRSAKGTEALR

SEQ ID NO: 13392 - protein, 9 aa, Brucella spp.
YMGSADKAL

SEQ ID NO: 13393 - protein, 4 aa, Brucella spp.
GAGL

SEQ ID NO: 13394 - protein, 11 aa, Brucella spp.
RVGPQLEEPAK

SEQ ID NO: 13395 - protein, 11 aa, Brucella spp.
RHEGAAATALK

SEQ ID NO: 13396 - protein, 4 aa, Brucella spp.
EGER

SEQ ID NO: 13397 - protein, 9 aa, Brucella spp.
GTSGAGKST

SEQ ID NO: 13398 - protein, 11 aa, Brucella spp.
IAAESGSVAAL

SEQ ID NO: 13399 - protein, 8 aa, Brucella spp.
KPDATDAE

SEQ ID NO: 13400 - protein, 23 aa, Brucella spp.
APAGLDTALGEGGMGLSGGQARR

SEQ ID NO: 13401 - protein, 13 aa, Brucella spp.
DEPTEGLDHATAE

SEQ ID NO: 13402 - protein, 7 aa, Brucella spp.
SEKAAGR

SEQ ID NO: 13403 - protein, 4 aa, Brucella spp.
GRET

SEQ ID NO: 13404 - protein, 14 aa, Brucella spp.
KGEPLFDDILKTMR

SEQ ID NO: 13405 - protein, 11 aa, Brucella spp.
APTIGSSFGAG

SEQ ID NO: 13406 - protein, 20 aa, Brucella spp.
RDRTRDSKELPSSSESFQGR

SEQ ID NO: 13407 - protein, 7 aa, Brucella spp.
QKNHIRS

SEQ ID NO: 13408 - protein, 7 aa, Brucella spp.
PGRQRHP

SEQ ID NO: 13409 - protein, 6 aa, Brucella spp.
ASPGTA

SEQ ID NO: 13410 - protein, 7 aa, Brucella spp.
SEKAPEA

SEQ ID NO: 13411 - protein, 8 aa, Brucella spp.
GSGPARVK

SEQ ID NO: 13412 - protein, 6 aa, Brucella spp.
TAAAAP

SEQ ID NO: 13413 - protein, 7 aa, Brucella spp.
AGSSYGF

SEQ ID NO: 13414 - protein, 9 aa, Brucella spp.
GSGNTAMPG

SEQ ID NO: 13415 - protein, 7 aa, Brucella spp.
RGQDAAA

SEQ ID NO: 13416 - protein, 15 aa, Brucella spp.
AYGDDEEEEDEEEVG

SEQ ID NO: 13417 - protein, 15 aa, Brucella spp.
NGDGSAPQLTAPVSA

SEQ ID NO: 13418 - protein, 10 aa, Brucella spp.
ARSLHNPDDY

SEQ ID NO: 13419 - protein, 12 aa, Brucella spp.
APRTGAETAGAQ

SEQ ID NO: 13420 - protein, 9 aa, Brucella spp.
RTDAPPVLE

SEQ ID NO: 13421 - protein, 9 aa, Brucella spp.
AAQYTDPVP

SEQ ID NO: 13422 - protein, 14 aa, Brucella spp.
RGLTRTDHVDGKEN

SEQ ID NO: 13423 - protein, 4 aa, Brucella spp.
AELE

SEQ ID NO: 13424 - protein, 8 aa, Brucella spp.
ITSPQKDH

SEQ ID NO: 13425 - protein, 7 aa, Brucella spp.
VSNPDKI

SEQ ID NO: 13426 - protein, 6 aa, Brucella spp.
VKPKPL

SEQ ID NO: 13427 - protein, 17 aa, Brucella spp.
AQAMPDRGGENGASCSV

SEQ ID NO: 13428 - protein, 6 aa, Brucella spp.
SAEEAR

SEQ ID NO: 13429 - protein, 7 aa, Brucella spp.
ENFDPNR

SEQ ID NO: 13430 - protein, 7 aa, Brucella spp.
TGGCPED

SEQ ID NO: 13431 - protein, 13 aa, Brucella spp.
CSQSASAENGLKA

SEQ ID NO: 13432 - protein, 12 aa, Brucella spp.
EARKAKAAGATR

SEQ ID NO: 13433 - protein, 9 aa, Brucella spp.
RSPKDRDMP

SEQ ID NO: 13434 - protein, 11 aa, Brucella spp.
SDKAEKLADAG

SEQ ID NO: 13435 - protein, 5 aa, Brucella spp.
DTSER

SEQ ID NO: 13436 - protein, 4 aa, Brucella spp.
RSFE

SEQ ID NO: 13437 - protein, 7 aa, Brucella spp.
GEEAEDR

SEQ ID NO: 13438 - protein, 8 aa, Brucella spp.
LPEPPESV

SEQ ID NO: 13439 - protein, 8 aa, Brucella spp.
AKAAPVDP

SEQ ID NO: 13440 - protein, 9 aa, Brucella spp.
AGRTAMSDE

SEQ ID NO: 13441 - protein, 12 aa, Brucella spp.
AANPGDDRDSSL

SEQ ID NO: 13442 - protein, 9 aa, Brucella spp.
LERKGRRRN

SEQ ID NO: 13443 - protein, 6 aa, Brucella spp.
DFSSND

SEQ ID NO: 13444 - protein, 5 aa, Brucella spp.
HPGIK

SEQ ID NO: 13445 - protein, 10 aa, Brucella spp.
VPLGATGSRL

SEQ ID NO: 13446 - protein, 11 aa, Brucella spp.
NHAEHEALEAE

SEQ ID NO: 13447 - protein, 8 aa, Brucella spp.
STLPQPGD

SEQ ID NO: 13448 - protein, 22 aa, Brucella spp.
AGIRAGRAEAVGARHNDAQAFE

SEQ ID NO: 13449 - protein, 9 aa, Brucella spp.
RENGGRGTP

SEQ ID NO: 13450 - protein, 8 aa, Brucella spp.
MDGDQAPL

SEQ ID NO: 13451 - protein, 18 aa, Brucella spp.
ATGVYGANGGGFAATLGD

SEQ ID NO: 13452 - protein, 8 aa, Brucella spp.
KALGGSGA

SEQ ID NO: 13453 - protein, 7 aa, Brucella spp.
APSPLQA

SEQ ID NO: 13454 - protein, 7 aa, Brucella spp.
DQPERRA

SEQ ID NO: 13455 - protein, 5 aa, Brucella spp.
ANERI

SEQ ID NO: 13456 - protein, 8 aa, Brucella spp.
LGQPVSGT

SEQ ID NO: 13457 - protein, 4 aa, Brucella spp.
NERA

SEQ ID NO: 13458 - protein, 9 aa, Brucella spp.
RPPTVPHGT

SEQ ID NO: 13459 - protein, 7 aa, Brucella spp.
LEPRPDR

SEQ ID NO: 13460 - protein, 5 aa, Brucella spp.
QASAD

SEQ ID NO: 13461 - protein, 7 aa, Brucella spp.
HQPAEEL

SEQ ID NO: 13462 - protein, 4 aa, Brucella spp.
APDG

SEQ ID NO: 13463 - protein, 8 aa, Brucella spp.
SDSGSTAV

SEQ ID NO: 13464 - protein, 7 aa, Brucella spp.
RGEPRSR

SEQ ID NO: 13465 - protein, 14 aa, Brucella spp.
HGDTIGTMSAGERG

SEQ ID NO: 13466 - protein, 10 aa, Brucella spp.
PFPSPGHEQP

SEQ ID NO: 13467 - protein, 4 aa, Brucella spp.
CRGG

SEQ ID NO: 13468 - protein, 4 aa, Brucella spp.
WGRT

SEQ ID NO: 13469 - protein, 4 aa, Brucella spp.
AGIT

SEQ ID NO: 13470 - protein, 8 aa, Brucella spp.
KGLTGGSL

SEQ ID NO: 13471 - protein, 8 aa, Brucella spp.
YSDDRSKT

SEQ ID NO: 13472 - protein, 8 aa, Brucella spp.
SSYTANPI

SEQ ID NO: 13473 - protein, 4 aa, Brucella spp.
VTER

SEQ ID NO: 13474 - protein, 6 aa, Brucella spp.
DSRFAG

SEQ ID NO: 13475 - protein, 6 aa, Brucella spp.
RQTGTI

SEQ ID NO: 13476 - protein, 13 aa, Brucella spp.
PAGGYLSDAGPKL

SEQ ID NO: 13477 - protein, 4 aa, Brucella spp.
ELDR

SEQ ID NO: 13478 - protein, 5 aa, Brucella spp.
AVRQD

SEQ ID NO: 13479 - protein, 7 aa, Brucella spp.
KVTTETQ

SEQ ID NO: 13480 - protein, 5 aa, Brucella spp.
RHTPA

SEQ ID NO: 13481 - protein, 4 aa, Brucella spp.
NDQR

SEQ ID NO: 13482 - protein, 10 aa, Brucella spp.
DLPAKASGVF

SEQ ID NO: 13483 - protein, 9 aa, Brucella spp.
KSDIPADSG

SEQ ID NO: 13484 - protein, 5 aa, Brucella spp.
DSTET

SEQ ID NO: 13485 - protein, 6 aa, Brucella spp.
DTTSLA

SEQ ID NO: 13486 - protein, 5 aa, Brucella spp.
QPEAK

SEQ ID NO: 13487 - protein, 14 aa, Brucella spp.
FPGDDAKRPPENRW

SEQ ID NO: 13488 - protein, 13 aa, Brucella spp.
QSTPYDIERIGKV

SEQ ID NO: 13489 - protein, 10 aa, Brucella spp.
GRRDEAGISP

SEQ ID NO: 13490 - protein, 9 aa, Brucella spp.
SRVGTGNIT

SEQ ID NO: 13491 - protein, 6 aa, Brucella spp.
AYSESA

SEQ ID NO: 13492 - protein, 10 aa, Brucella spp.
NQDGQYRGGP

SEQ ID NO: 13493 - protein, 7 aa, Brucella spp.
GGVTGGI

SEQ ID NO: 13494 - protein, 11 aa, Brucella spp.
NEAGMGSAPNI

SEQ ID NO: 13495 - protein, 13 aa, Brucella spp.
ATPAPHHPSSQGF

SEQ ID NO: 13496 - protein, 11 aa, Brucella spp.
EPGSGLTGTQL

SEQ ID NO: 13497 - protein, 4 aa, Brucella spp.
SYAE

SEQ ID NO: 13498 - protein, 8 aa, Brucella spp.
RRAGQVPT

SEQ ID NO: 13499 - protein, 6 aa, Brucella spp.
YPELQG

SEQ ID NO: 13500 - protein, 8 aa, Brucella spp.
EPSPQDGY

SEQ ID NO: 13501 - protein, 9 aa, Brucella spp.
RGMTKEKAR

SEQ ID NO: 13502 - protein, 6 aa, Brucella spp.
IAPSTE

SEQ ID NO: 13503 - protein, 7 aa, Brucella spp.
PAKWGDF

SEQ ID NO: 13504 - protein, 12 aa, Brucella spp.
KYREELESKLPA

SEQ ID NO: 13505 - protein, 6 aa, Brucella spp.
AGAGGR

SEQ ID NO: 13506 - protein, 7 aa, Brucella spp.
KDEEHNQ

SEQ ID NO: 13507 - protein, 9 aa, Brucella spp.
SVETTDNAY

SEQ ID NO: 13508 - protein, 8 aa, Brucella spp.
TDYEQVKK

SEQ ID NO: 13509 - protein, 7 aa, Brucella spp.
RSYQQKL

SEQ ID NO: 13510 - protein, 40 aa, Brucella spp.
AALDSKKAALANSEQSQRSAEATIKAREAQISGAKAALEV

SEQ ID NO: 13511 - protein, 5 aa, Brucella spp.
ANTVR

SEQ ID NO: 13512 - protein, 15 aa, Brucella spp.
RGVTTQSSADTAHGN

SEQ ID NO: 13513 - protein, 8 aa, Brucella spp.
AAVDQAEA

SEQ ID NO: 13514 - protein, 4 aa, Brucella spp.
HNAE

SEQ ID NO: 13515 - protein, 11 aa, Brucella spp.
LAPRDGKLGEV

SEQ ID NO: 13516 - protein, 9 aa, Brucella spp.
FSPATGSEF

SEQ ID NO: 13517 - protein, 9 aa, Brucella spp.
SDNATGNFT

SEQ ID NO: 13518 - protein, 8 aa, Brucella spp.
DEGQPDAE

SEQ ID NO: 13519 - protein, 6 aa, Brucella spp.
DEGTSL

SEQ ID NO: 13520 - protein, 7 aa, Brucella spp.
ADVGKKI

SEQ ID NO: 13521 - protein, 5 aa, Brucella spp.
SDDYT

SEQ ID NO: 13522 - protein, 8 aa, Brucella spp.
VGKGTRMP

SEQ ID NO: 13523 - protein, 21 aa, Brucella spp.
SAEQYRVTQENGTERPGTGEY

SEQ ID NO: 13524 - protein, 4 aa, Brucella spp.
KEPG

SEQ ID NO: 13525 - protein, 12 aa, Brucella spp.
PLFASSDKYESH

SEQ ID NO: 13526 - protein, 7 aa, Brucella spp.
KPIERAN

SEQ ID NO: 13527 - protein, 8 aa, Brucella spp.
VRSAHGDS

SEQ ID NO: 13528 - protein, 8 aa, Brucella spp.
DGPVDRGG

SEQ ID NO: 13529 - protein, 16 aa, Brucella spp.
RMEAEGYGDYLDQVEG

SEQ ID NO: 13530 - protein, 7 aa, Brucella spp.
EGNFTRA

SEQ ID NO: 13531 - protein, 11 aa, Brucella spp.
LGIGQPPLSQQ

SEQ ID NO: 13532 - protein, 6 aa, Brucella spp.
AELTAA

SEQ ID NO: 13533 - protein, 25 aa, Brucella spp.
TATIASSEKAKLAAQRAARGESGRL

SEQ ID NO: 13534 - protein, 5 aa, Brucella spp.
SAFNP

SEQ ID NO: 13535 - protein, 7 aa, Brucella spp.
GLEDPAN

SEQ ID NO: 13536 - protein, 7 aa, Brucella spp.
QEAPQMP

SEQ ID NO: 13537 - protein, 7 aa, Brucella spp.
YRPIEGE

SEQ ID NO: 13538 - protein, 5 aa, Brucella spp.
LRSPV

SEQ ID NO: 13539 - protein, 4 aa, Brucella spp.
AQKG

SEQ ID NO: 13540 - protein, 14 aa, Brucella spp.
GGKAHVTDATNASR

SEQ ID NO: 13541 - protein, 7 aa, Brucella spp.
AGDQQAA

SEQ ID NO: 13542 - protein, 5 aa, Brucella spp.
STYGT

SEQ ID NO: 13543 - protein, 10 aa, Brucella spp.
GTDRVTSSNR

SEQ ID NO: 13544 - protein, 13 aa, Brucella spp.
VSALAEKADPNQR

SEQ ID NO: 13545 - protein, 8 aa, Brucella spp.
RGTGRAEF

SEQ ID NO: 13546 - protein, 9 aa, Brucella spp.
GDWKGATNH

SEQ ID NO: 13547 - protein, 12 aa, Brucella spp.
GIWPDRKGFSER

SEQ ID NO: 13548 - protein, 12 aa, Brucella spp.
AMPEKERESAIA

SEQ ID NO: 13549 - protein, 9 aa, Brucella spp.
GLAAADGNI

SEQ ID NO: 13550 - protein, 4 aa, Brucella spp.
QPAL

SEQ ID NO: 13551 - protein, 8 aa, Brucella spp.
KIASSLSQ

SEQ ID NO: 13552 - protein, 8 aa, Brucella spp.
KAPGKYEF

SEQ ID NO: 13553 - protein, 14 aa, Brucella spp.
GGGAGKGEAPSVTA

SEQ ID NO: 13554 - protein, 5 aa, Brucella spp.
QQEYA

SEQ ID NO: 13555 - protein, 7 aa, Brucella spp.
ELKGTDF

SEQ ID NO: 13556 - protein, 9 aa, Brucella spp.
PEQTAANKD

SEQ ID NO: 13557 - protein, 22 aa, Brucella spp.
LAAERRALEAQAASYGDEITTL

SEQ ID NO: 13558 - protein, 23 aa, Brucella spp.
NVNSSKSLVDRGLAAKSSLRDME

SEQ ID NO: 13559 - protein, 10 aa, Brucella spp.
RDLSSTRRDA

SEQ ID NO: 13560 - protein, 5 aa, Brucella spp.
RQNQL

SEQ ID NO: 13561 - protein, 14 aa, Brucella spp.
LDETRRSEAASSLQ

SEQ ID NO: 13562 - protein, 9 aa, Brucella spp.
QRRSNSQLE

SEQ ID NO: 13563 - protein, 12 aa, Brucella spp.
AKSSGQISSADM

SEQ ID NO: 13564 - protein, 7 aa, Brucella spp.
VNGAYQE

SEQ ID NO: 13565 - protein, 11 aa, Brucella spp.
AANERTEIKPG

SEQ ID NO: 13566 - protein, 4 aa, Brucella spp.
RQPV

SEQ ID NO: 13567 - protein, 18 aa, Brucella spp.
ALPNESAITPLPQDSPVL

SEQ ID NO: 13568 - protein, 5 aa, Brucella spp.
AVPTD

SEQ ID NO: 13569 - protein, 11 aa, Brucella spp.
LSSQPDRITLS

SEQ ID NO: 13570 - protein, 14 aa, Brucella spp.
KNARDFDPAVRERQ

SEQ ID NO: 13571 - protein, 7 aa, Brucella spp.
VSNDGRS

SEQ ID NO: 13572 - protein, 6 aa, Brucella spp.
APDPVY

SEQ ID NO: 13573 - protein, 9 aa, Brucella spp.
VQQSAARRV

SEQ ID NO: 13574 - protein, 25 aa, Brucella spp.
LETAERVAEDFRQKSRLAGEQGQIS

SEQ ID NO: 13575 - protein, 26 aa, Brucella spp.
TGAVSTAQARLQTAQALKNNNEAPAM

SEQ ID NO: 13576 - protein, 12 aa, Brucella spp.
AIQNLRNEEARV

SEQ ID NO: 13577 - protein, 9 aa, Brucella spp.
KANGALKSA

SEQ ID NO: 13578 - protein, 9 aa, Brucella spp.
ESLKQQITA

SEQ ID NO: 13579 - protein, 26 aa, Brucella spp.
RRTSLEKELKEAETDLAKANQAQVRA

SEQ ID NO: 13580 - protein, 10 aa, Brucella spp.
QLDREANASR

SEQ ID NO: 13581 - protein, 13 aa, Brucella spp.
SQAEPAMAKASPR

SEQ ID NO: 13582 - protein, 7 aa, Brucella spp.
IRPAQTT

SEQ ID NO: 13583 - protein, 4 aa, Brucella spp.
PGIP

SEQ ID NO: 13584 - protein, 9 aa, Brucella spp.
VDSASPFGR

SEQ ID NO: 13585 - protein, 8 aa, Brucella spp.
LSEGDGKG

SEQ ID NO: 13586 - protein, 5 aa, Brucella spp.
IAATG

SEQ ID NO: 13587 - protein, 10 aa, Brucella spp.
TCGKSGLGEA

SEQ ID NO: 13588 - protein, 9 aa, Brucella spp.
PNRQAQEGE

SEQ ID NO: 13589 - protein, 10 aa, Brucella spp.
SYAEDKRSAL

SEQ ID NO: 13590 - protein, 5 aa, Brucella spp.
TRATD

SEQ ID NO: 13591 - protein, 9 aa, Brucella spp.
DRRDAKATA

SEQ ID NO: 13592 - protein, 5 aa, Brucella spp.
GRKPA

SEQ ID NO: 13593 - protein, 4 aa, Brucella spp.
SPYA

SEQ ID NO: 13594 - protein, 14 aa, Brucella spp.
RGREAPSTPMEEQA

SEQ ID NO: 13595 - protein, 6 aa, Brucella spp.
KNPHNI

SEQ ID NO: 13596 - protein, 8 aa, Brucella spp.
KISTEKDQ

SEQ ID NO: 13597 - protein, 5 aa, Brucella spp.
TNNSV

SEQ ID NO: 13598 - protein, 7 aa, Brucella spp.
HQRRNRK

SEQ ID NO: 13599 - protein, 11 aa, Brucella spp.
GQKVSDPAVGN

SEQ ID NO: 13600 - protein, 5 aa, Brucella spp.
EEISQ

SEQ ID NO: 13601 - protein, 4 aa, Brucella spp.
YIPT

SEQ ID NO: 13602 - protein, 11 aa, Brucella spp.
ATEAGGQRIQP

SEQ ID NO: 13603 - protein, 6 aa, Brucella spp.
RRGKAN

SEQ ID NO: 13604 - protein, 4 aa, Brucella spp.
REST

SEQ ID NO: 13605 - protein, 7 aa, Brucella spp.
KASNRTE

SEQ ID NO: 13606 - protein, 8 aa, Brucella spp.
KNGAAARI

SEQ ID NO: 13607 - protein, 6 aa, Brucella spp.
GSAGTD

SEQ ID NO: 13608 - protein, 7 aa, Brucella spp.
NNPSKGW

SEQ ID NO: 13609 - protein, 14 aa, Brucella spp.
IGPATNGAAMAAAG

SEQ ID NO: 13610 - protein, 12 aa, Brucella spp.
GNGKATPDAKSP

SEQ ID NO: 13611 - protein, 28 aa, Brucella spp.
YDPGSDGWSKLDTQTPVGLSGAKAVGLA

SEQ ID NO: 13612 - protein, 12 aa, Brucella spp.
AIDKDKEPEAYR

SEQ ID NO: 13613 - protein, 4 aa, Brucella spp.
EAYR

SEQ ID NO: 13614 - protein, 10 aa, Brucella spp.
PAGNNWGSLG

SEQ ID NO: 13615 - protein, 10 aa, Brucella spp.
IKPGLRTPEA

SEQ ID NO: 13616 - protein, 25 aa, Brucella spp.
DLPPLSGSEPQEGVAGAYAGKAGDD

SEQ ID NO: 13617 - protein, 14 aa, Brucella spp.
GANFKGAQANAAAG

SEQ ID NO: 13618 - protein, 4 aa, Brucella spp.
KSWR

SEQ ID NO: 13619 - protein, 7 aa, Brucella spp.
GKLPRGL

SEQ ID NO: 13620 - protein, 5 aa, Brucella spp.
FDAPG

SEQ ID NO: 13621 - protein, 10 aa, Brucella spp.
GEDRDGKARK

SEQ ID NO: 13622 - protein, 9 aa, Brucella spp.
PVPESPFDN

SEQ ID NO: 13623 - protein, 14 aa, Brucella spp.
RAAEASGASGLRIE

SEQ ID NO: 13624 - protein, 14 aa, Brucella spp.
GAANVAAAAQASTL

SEQ ID NO: 13625 - protein, 8 aa, Brucella spp.
DLDDSPVR

SEQ ID NO: 13626 - protein, 10 aa, Brucella spp.
ATDRRRPVPA

SEQ ID NO: 13627 - protein, 4 aa, Brucella spp.
RRGR

SEQ ID NO: 13628 - protein, 11 aa, Brucella spp.
LAEARNALAAG

SEQ ID NO: 13629 - protein, 15 aa, Brucella spp.
SGYTGEGPTPKDPDL

SEQ ID NO: 13630 - protein, 17 aa, Brucella spp.
GRYNSPQQAGEAIRAGA

SEQ ID NO: 13631 - protein, 5 aa, Brucella spp.
ITRPE

SEQ ID NO: 13632 - protein, 10 aa, Brucella spp.
ESAAKPSSPV

SEQ ID NO: 13633 - protein, 5 aa, Brucella spp.
GGTKT

SEQ ID NO: 13634 - protein, 10 aa, Brucella spp.
TTPASVGSES

SEQ ID NO: 13635 - protein, 8 aa, Brucella spp.
ADWQGRYQ

SEQ ID NO: 13636 - protein, 6 aa, Brucella spp.
TGRVDG

SEQ ID NO: 13637 - protein, 5 aa, Brucella spp.
NPETL

SEQ ID NO: 13638 - protein, 6 aa, Brucella spp.
IPPDYP

SEQ ID NO: 13639 - protein, 5 aa, Brucella spp.
QAAAW

SEQ ID NO: 13640 - protein, 4 aa, Brucella spp.
AARG

SEQ ID NO: 13641 - protein, 4 aa, Brucella spp.
GIGG

SEQ ID NO: 13642 - protein, 8 aa, Brucella spp.
ARGIAGSL

SEQ ID NO: 13643 - protein, 10 aa, Brucella spp.
AGHAGDARSV

SEQ ID NO: 13644 - protein, 7 aa, Brucella spp.
AAAGEGW

SEQ ID NO: 13645 - protein, 5 aa, Brucella spp.
LGADA

SEQ ID NO: 13646 - protein, 23 aa, Brucella spp.
APAMAAGTISGGFDVGPGGFQGN

SEQ ID NO: 13647 - protein, 7 aa, Brucella spp.
PLAATGG

SEQ ID NO: 13648 - protein, 7 aa, Brucella spp.
FEISPDQ

SEQ ID NO: 13649 - protein, 10 aa, Brucella spp.
DGEPFTSKDA

SEQ ID NO: 13650 - protein, 8 aa, Brucella spp.
RNGKTGSV

SEQ ID NO: 13651 - protein, 9 aa, Brucella spp.
SVETPDEKT

SEQ ID NO: 13652 - protein, 8 aa, Brucella spp.
KEPSPSML

SEQ ID NO: 13653 - protein, 7 aa, Brucella spp.
SIPPEQL

SEQ ID NO: 13654 - protein, 8 aa, Brucella spp.
STPIGTGP

SEQ ID NO: 13655 - protein, 13 aa, Brucella spp.
ANPDYRGGRPQVD

SEQ ID NO: 13656 - protein, 10 aa, Brucella spp.
NDVSTFSSDS

SEQ ID NO: 13657 - protein, 8 aa, Brucella spp.
GGAAKPAN

SEQ ID NO: 13658 - protein, 9 aa, Brucella spp.
AYDPQKARQ

SEQ ID NO: 13659 - protein, 9 aa, Brucella spp.
DKINGSKPI

SEQ ID NO: 13660 - protein, 7 aa, Brucella spp.
VDTPTYN

SEQ ID NO: 13661 - protein, 8 aa, Brucella spp.
KQGGTADE

SEQ ID NO: 13662 - protein, 10 aa, Brucella spp.
QNGPDPSSIN

SEQ ID NO: 13663 - protein, 8 aa, Brucella spp.
KQIPPAGS

SEQ ID NO: 13664 - protein, 15 aa, Brucella spp.
ALAETNPAKRDARYQ

SEQ ID NO: 13665 - protein, 6 aa, Brucella spp.
ATNANL

SEQ ID NO: 13666 - protein, 6 aa, Brucella spp.
GVASSK

SEQ ID NO: 13667 - protein, 19 aa, Brucella spp.
PAPAGGPYQAHPEKWSILE

SEQ ID NO: 13668 - protein, 4 aa, Brucella spp.
MARS

SEQ ID NO: 13669 - protein, 4 aa, Brucella spp.
SAPS

SEQ ID NO: 13670 - protein, 5 aa, Brucella spp.
DGVGR

SEQ ID NO: 13671 - protein, 4 aa, Brucella spp.
MEGG

SEQ ID NO: 13672 - protein, 4 aa, Brucella spp.
LGGR

SEQ ID NO: 13673 - protein, 5 aa, Brucella spp.
GMGAG

SEQ ID NO: 13674 - protein, 8 aa, Brucella spp.
VPPPAASW

SEQ ID NO: 13675 - protein, 5 aa, Brucella spp.
ARSTA

SEQ ID NO: 13676 - protein, 8 aa, Brucella spp.
DNEPEKAA

SEQ ID NO: 13677 - protein, 4 aa, Brucella spp.
VGVS

SEQ ID NO: 13678 - protein, 4 aa, Brucella spp.
EQRN

SEQ ID NO: 13679 - protein, 9 aa, Brucella spp.
DALRDTNRL

SEQ ID NO: 13680 - protein, 7 aa, Brucella spp.
GPPQRYV

SEQ ID NO: 13681 - protein, 8 aa, Brucella spp.
SISGGGAL

SEQ ID NO: 13682 - protein, 4 aa, Brucella spp.
QEIT

SEQ ID NO: 13683 - protein, 5 aa, Brucella spp.
DGTIG

SEQ ID NO: 13684 - protein, 9 aa, Brucella spp.
RNASLTDHG

SEQ ID NO: 13685 - protein, 9 aa, Brucella spp.
DGKMRERPA

SEQ ID NO: 13686 - protein, 9 aa, Brucella spp.
CNGGKPAVT

SEQ ID NO: 13687 - protein, 8 aa, Brucella spp.
WDPRSEAV

SEQ ID NO: 13688 - protein, 4 aa, Brucella spp.
ETFS

SEQ ID NO: 13689 - protein, 11 aa, Brucella spp.
VPSGMDPPQHT

SEQ ID NO: 13690 - protein, 4 aa, Brucella spp.
SLQG

SEQ ID NO: 13691 - protein, 10 aa, Brucella spp.
AATLARDTKA

SEQ ID NO: 13692 - protein, 14 aa, Brucella spp.
RRKLGADAPDDVTT

SEQ ID NO: 13693 - protein, 5 aa, Brucella spp.
RRNLT

SEQ ID NO: 13694 - protein, 8 aa, Brucella spp.
KSQQTQAL

SEQ ID NO: 13695 - protein, 5 aa, Brucella spp.
GGPDL

SEQ ID NO: 13696 - protein, 5 aa, Brucella spp.
RRVTT

SEQ ID NO: 13697 - protein, 7 aa, Brucella spp.
REIPAGE

SEQ ID NO: 13698 - protein, 7 aa, Brucella spp.
ANRDEAV

SEQ ID NO: 13699 - protein, 13 aa, Brucella spp.
FDKPDELRLNRDP

SEQ ID NO: 13700 - protein, 4 aa, Brucella spp.
PGSV

SEQ ID NO: 13701 - protein, 12 aa, Brucella spp.
ASGFSRLPARIS

SEQ ID NO: 13702 - protein, 4 aa, Brucella spp.
SSTV

SEQ ID NO: 13703 - protein, 17 aa, Brucella spp.
NAVRKVSKGDIDLTGSP

SEQ ID NO: 13704 - protein, 5 aa, Brucella spp.
GENGN

SEQ ID NO: 13705 - protein, 8 aa, Brucella spp.
ASGADEIT

SEQ ID NO: 13706 - protein, 4 aa, Brucella spp.
HIDP

SEQ ID NO: 13707 - protein, 5 aa, Brucella spp.
TASFD

SEQ ID NO: 13708 - protein, 9 aa, Brucella spp.
SQRAPELAE

SEQ ID NO: 13709 - protein, 4 aa, Brucella spp.
GSGA

SEQ ID NO: 13710 - protein, 7 aa, Brucella spp.
KSLDTSM

SEQ ID NO: 13711 - protein, 5 aa, Brucella spp.
KMEAD

SEQ ID NO: 13712 - protein, 10 aa, Brucella spp.
GLSGDTRDLL

SEQ ID NO: 13713 - protein, 9 aa, Brucella spp.
ESDAPQAHT

SEQ ID NO: 13714 - protein, 6 aa, Brucella spp.
GEHQPA

SEQ ID NO: 13715 - protein, 8 aa, Brucella spp.
DPAANDEN

SEQ ID NO: 13716 - protein, 7 aa, Brucella spp.
SRTSRTA

SEQ ID NO: 13717 - protein, 5 aa, Brucella spp.
DEEQI

SEQ ID NO: 13718 - protein, 5 aa, Brucella spp.
QPEHI

SEQ ID NO: 13719 - protein, 5 aa, Brucella spp.
GTTPG

SEQ ID NO: 13720 - protein, 8 aa, Brucella spp.
PGHGGPGM

SEQ ID NO: 13721 - protein, 8 aa, Brucella spp.
ISEDEAGM

SEQ ID NO: 13722 - protein, 21 aa, Brucella spp.
GGIPSHAAPETPGSIHEGGEL

SEQ ID NO: 13723 - protein, 4 aa, Brucella spp.
FDNP

SEQ ID NO: 13724 - protein, 10 aa, Brucella spp.
DGEAETGALA

SEQ ID NO: 13725 - protein, 6 aa, Brucella spp.
NPARDG

SEQ ID NO: 13726 - protein, 5 aa, Brucella spp.
SDDDL

SEQ ID NO: 13727 - protein, 8 aa, Brucella spp.
GSEPADMH

SEQ ID NO: 13728 - protein, 13 aa, Brucella spp.
KKNADVHSPERPR

SEQ ID NO: 13729 - protein, 11 aa, Brucella spp.
PKGWTGPKTVD

SEQ ID NO: 13730 - protein, 7 aa, Brucella spp.
CRENDAH

SEQ ID NO: 13731 - protein, 17 aa, Brucella spp.
YDPSDLFDEKGALKPEL

SEQ ID NO: 13732 - protein, 19 aa, Brucella spp.
LAPKGEARIGANPHANGGL

SEQ ID NO: 13733 - protein, 13 aa, Brucella spp.
VTEPGAIEAQSTK

SEQ ID NO: 13734 - protein, 5 aa, Brucella spp.
NETEK

SEQ ID NO: 13735 - protein, 10 aa, Brucella spp.
PDETASNRLG

SEQ ID NO: 13736 - protein, 4 aa, Brucella spp.
AADG

SEQ ID NO: 13737 - protein, 9 aa, Brucella spp.
NGFSHQDPG

SEQ ID NO: 13738 - protein, 6 aa, Brucella spp.
NKSADI

SEQ ID NO: 13739 - protein, 4 aa, Brucella spp.
PPDA

SEQ ID NO: 13740 - protein, 7 aa, Brucella spp.
GKQPEPQ

SEQ ID NO: 13741 - protein, 5 aa, Brucella spp.
EKHCE

SEQ ID NO: 13742 - protein, 7 aa, Brucella spp.
TEDGLEP

SEQ ID NO: 13743 - protein, 5 aa, Brucella spp.
DVPTM

SEQ ID NO: 13744 - protein, 12 aa, Brucella spp.
PHQHPHGISDEE

SEQ ID NO: 13745 - protein, 5 aa, Brucella spp.
TNHSN

SEQ ID NO: 13746 - protein, 8 aa, Brucella spp.
QGTTTTPF

SEQ ID NO: 13747 - protein, 18 aa, Brucella spp.
QHGEDMPEIRDWKWTWPR

SEQ ID NO: 13748 - protein, 9 aa, Brucella spp.
RPAQEQRTG

SEQ ID NO: 13749 - protein, 7 aa, Brucella spp.
SDDAQDY

SEQ ID NO: 13750 - protein, 5 aa, Brucella spp.
GRTLK

SEQ ID NO: 13751 - protein, 6 aa, Brucella spp.
TDVADK

SEQ ID NO: 13752 - protein, 5 aa, Brucella spp.
REGSE

SEQ ID NO: 13753 - protein, 6 aa, Brucella spp.
ISASNY

SEQ ID NO: 13754 - protein, 4 aa, Brucella spp.
TGYR

SEQ ID NO: 13755 - protein, 11 aa, Brucella spp.
GAQAKEIPIGK

SEQ ID NO: 13756 - protein, 9 aa, Brucella spp.
RPAKDSDVH

SEQ ID NO: 13757 - protein, 12 aa, Brucella spp.
KAAKDNTNGFAE

SEQ ID NO: 13758 - protein, 9 aa, Brucella spp.
DNGKVQKGD

SEQ ID NO: 13759 - protein, 7 aa, Brucella spp.
DGPHYGD

SEQ ID NO: 13760 - protein, 8 aa, Brucella spp.
KLDGPGKY

SEQ ID NO: 13761 - protein, 8 aa, Brucella spp.
SPPSANQH

SEQ ID NO: 13762 - protein, 7 aa, Brucella spp.
DKETGVG

SEQ ID NO: 13763 - protein, 5 aa, Brucella spp.
AEYGR

SEQ ID NO: 13764 - protein, 12 aa, Brucella spp.
GSAGSAKLPQAE

SEQ ID NO: 13765 - protein, 4 aa, Brucella spp.
YRDM

SEQ ID NO: 13766 - protein, 7 aa, Brucella spp.
DASPIGF

SEQ ID NO: 13767 - protein, 19 aa, Brucella spp.
TASLSTGGNIVSGKAYERI

SEQ ID NO: 13768 - protein, 9 aa, Brucella spp.
ISDGASELK

SEQ ID NO: 13769 - protein, 11 aa, Brucella spp.
KERVEESFGRQ

SEQ ID NO: 13770 - protein, 6 aa, Brucella spp.
APGKGE

SEQ ID NO: 13771 - protein, 7 aa, Brucella spp.
VTKPGRT

SEQ ID NO: 13772 - protein, 7 aa, Brucella spp.
PRPGHEY

SEQ ID NO: 13773 - protein, 5 aa, Brucella spp.
HGQTI

SEQ ID NO: 13774 - protein, 7 aa, Brucella spp.
GNEARQT

SEQ ID NO: 13775 - protein, 23 aa, Brucella spp.
MTTSAGAPIPDNQNSLTAGERGP

SEQ ID NO: 13776 - protein, 10 aa, Brucella spp.
HQNRERIPER

SEQ ID NO: 13777 - protein, 5 aa, Brucella spp.
GWGAY

SEQ ID NO: 13778 - protein, 5 aa, Brucella spp.
ISRYT

SEQ ID NO: 13779 - protein, 9 aa, Brucella spp.
VLQPGAQTP

SEQ ID NO: 13780 - protein, 14 aa, Brucella spp.
AGELGAADAERDVR

SEQ ID NO: 13781 - protein, 7 aa, Brucella spp.
KRHPRTH

SEQ ID NO: 13782 - protein, 4 aa, Brucella spp.
PESL

SEQ ID NO: 13783 - protein, 6 aa, Brucella spp.
RGLPTD

SEQ ID NO: 13784 - protein, 5 aa, Brucella spp.
GYGSH

SEQ ID NO: 13785 - protein, 19 aa, Brucella spp.
TNAEAEQVIGRTRESTQED

SEQ ID NO: 13786 - protein, 5 aa, Brucella spp.
NGEFP

SEQ ID NO: 13787 - protein, 9 aa, Brucella spp.
ADKTPYNPF

SEQ ID NO: 13788 - protein, 5 aa, Brucella spp.
DYPPI

SEQ ID NO: 13789 - protein, 6 aa, Brucella spp.
RNPENY

SEQ ID NO: 13790 - protein, 8 aa, Brucella spp.
AAFSPSNI

SEQ ID NO: 13791 - protein, 6 aa, Brucella spp.
PVNQPK

SEQ ID NO: 13792 - protein, 29 aa, Brucella spp.
IKTGNPDAYYEPNSFNGPVEQPSAKEPPL

SEQ ID NO: 13793 - protein, 19 aa, Brucella spp.
GNADRYNHRIGNDDYSQPR

SEQ ID NO: 13794 - protein, 4 aa, Brucella spp.
QKQR

SEQ ID NO: 13795 - protein, 5 aa, Brucella spp.
GVRKA

SEQ ID NO: 13796 - protein, 9 aa, Brucella spp.
KDAHGYDAN

SEQ ID NO: 13797 - protein, 54 aa, Brucella spp.
ATSDSSRSKPASARPHASNVAENSTKAAPQNAAAVADKEKEKAPAAKAVEPEQA

SEQ ID NO: 13798 - protein, 10 aa, Brucella spp.
ADPDTLPDNA

SEQ ID NO: 13799 - protein, 15 aa, Brucella spp.
GPEVADEAKRFAGNN

SEQ ID NO: 13800 - protein, 7 aa, Brucella spp.
AGTKQYG

SEQ ID NO: 13801 - protein, 13 aa, Brucella spp.
PQYRSREGQIGTI

SEQ ID NO: 13802 - protein, 11 aa, Brucella spp.
LNGEPLPLDSA

SEQ ID NO: 13803 - protein, 29 aa, Brucella spp.
GTVVGEETKGRGSGKMPELKRAADPVHGE

SEQ ID NO: 13804 - protein, 20 aa, Brucella spp.
GADGQGKRTGVVGDAKSYEF

SEQ ID NO: 13805 - protein, 10 aa, Brucella spp.
PDSFNDGAGM

SEQ ID NO: 13806 - protein, 15 aa, Brucella spp.
NGVSLEEPQLEPEDA

SEQ ID NO: 13807 - protein, 35 aa, Brucella spp.
SKPRPAKANLQNDFPNRLEKPVDASYGPYADSFPA

SEQ ID NO: 13808 - protein, 8 aa, Brucella spp.
PGHSEVMP

SEQ ID NO: 13809 - protein, 6 aa, Brucella spp.
DTVTES

SEQ ID NO: 13810 - protein, 11 aa, Brucella spp.
LSPERQAEEVR

SEQ ID NO: 13811 - protein, 10 aa, Brucella spp.
IGPDATLADA

SEQ ID NO: 13812 - protein, 9 aa, Brucella spp.
ENATKGPGR

SEQ ID NO: 13813 - protein, 8 aa, Brucella spp.
FASDPKQK

SEQ ID NO: 13814 - protein, 7 aa, Brucella spp.
VNQDEAK

SEQ ID NO: 13815 - protein, 34 aa, Brucella spp.
IEKSQLNPNAAKDAQGRLRAAAATSVGADGFERA

SEQ ID NO: 13816 - protein, 7 aa, Brucella spp.
AHGHSQR

SEQ ID NO: 13817 - protein, 5 aa, Brucella spp.
KAYPN

SEQ ID NO: 13818 - protein, 8 aa, Brucella spp.
VATTAGTQ

SEQ ID NO: 13819 - protein, 7 aa, Brucella spp.
VGIGPGS

SEQ ID NO: 13820 - protein, 7 aa, Brucella spp.
AAQKQNI

SEQ ID NO: 13821 - protein, 10 aa, Brucella spp.
AGTEESPGEV

SEQ ID NO: 13822 - protein, 6 aa, Brucella spp.
AYRGMG

SEQ ID NO: 13823 - protein, 10 aa, Brucella spp.
AMARGSADRY

SEQ ID NO: 13824 - protein, 6 aa, Brucella spp.
EGIEGQ

SEQ ID NO: 13825 - protein, 6 aa, Brucella spp.
AYKGPI

SEQ ID NO: 13826 - protein, 5 aa, Brucella spp.
LEEFR

SEQ ID NO: 13827 - protein, 9 aa, Brucella spp.
AGLRESHSH

SEQ ID NO: 13828 - protein, 6 aa, Brucella spp.
TSGSPL

SEQ ID NO: 13829 - protein, 10 aa, Brucella spp.
NSGGSGIPQA

SEQ ID NO: 13830 - protein, 6 aa, Brucella spp.
NDHEDR

SEQ ID NO: 13831 - protein, 9 aa, Brucella spp.
IGREGPTVQ

SEQ ID NO: 13832 - protein, 4 aa, Brucella spp.
GGME

SEQ ID NO: 13833 - protein, 5 aa, Brucella spp.
SAAGI

SEQ ID NO: 13834 - protein, 7 aa, Brucella spp.
YAARTNG

SEQ ID NO: 13835 - protein, 7 aa, Brucella spp.
VTASTGK

SEQ ID NO: 13836 - protein, 4 aa, Brucella spp.
QKAP

SEQ ID NO: 13837 - protein, 14 aa, Brucella spp.
AGYDQARSAVEGAT

SEQ ID NO: 13838 - protein, 8 aa, Brucella spp.
VGAGLGST

SEQ ID NO: 13839 - protein, 14 aa, Brucella spp.
QRRAREKTIQPELT

SEQ ID NO: 13840 - protein, 12 aa, Brucella spp.
TASAGAAKEGKT

SEQ ID NO: 13841 - protein, 6 aa, Brucella spp.
ITDVPG

SEQ ID NO: 13842 - protein, 6 aa, Brucella spp.
TRRPTG

SEQ ID NO: 13843 - protein, 20 aa, Brucella spp.
EGATAGVDVRGSAPGTRETD

SEQ ID NO: 13844 - protein, 8 aa, Brucella spp.
GGSAYGLA

SEQ ID NO: 13845 - protein, 9 aa, Brucella spp.
SVRPDEEAG

SEQ ID NO: 13846 - protein, 20 aa, Brucella spp.
AATAAPSGEGNIGAGAGATV

SEQ ID NO: 13847 - protein, 13 aa, Brucella spp.
GGLGTASYKVPGT

SEQ ID NO: 13848 - protein, 8 aa, Brucella spp.
DVRAPNSH

SEQ ID NO: 13849 - protein, 12 aa, Brucella spp.
GARTEDGKGFRN

SEQ ID NO: 13850 - protein, 11 aa, Brucella spp.
VKSGGANTTIG

SEQ ID NO: 13851 - protein, 9 aa, Brucella spp.
TNAPFGKAE

SEQ ID NO: 13852 - protein, 12 aa, Brucella spp.
TGKAKDGQADVT

SEQ ID NO: 13853 - protein, 15 aa, Brucella spp.
GSMSSNSLKFGTSGL

SEQ ID NO: 13854 - protein, 8 aa, Brucella spp.
KGQLQKGD

SEQ ID NO: 13855 - protein, 8 aa, Brucella spp.
LRPSSPDI

SEQ ID NO: 13856 - protein, 4 aa, Brucella spp.
AGFT

SEQ ID NO: 13857 - protein, 6 aa, Brucella spp.
AKAPSI

SEQ ID NO: 13858 - protein, 7 aa, Brucella spp.
HIPDDRN

SEQ ID NO: 13859 - protein, 15 aa, Brucella spp.
RDGEIDKDDEAAISA

SEQ ID NO: 13860 - protein, 12 aa, Brucella spp.
HVGSTETDAALQ

SEQ ID NO: 13861 - protein, 6 aa, Brucella spp.
KGSLNG

SEQ ID NO: 13862 - protein, 6 aa, Brucella spp.
EALRPE

SEQ ID NO: 13863 - protein, 6 aa, Brucella spp.
GKSDRL

SEQ ID NO: 13864 - protein, 10 aa, Brucella spp.
STDGDADRPL

SEQ ID NO: 13865 - protein, 12 aa, Brucella spp.
TPVTSNTALESR

SEQ ID NO: 13866 - protein, 10 aa, Brucella spp.
QVSTGNSGPV

SEQ ID NO: 13867 - protein, 15 aa, Brucella spp.
TVERNGRSLTALPTR

SEQ ID NO: 13868 - protein, 9 aa, Brucella spp.
EKKTPLSTI

SEQ ID NO: 13869 - protein, 9 aa, Brucella spp.
QNIPQEAST

SEQ ID NO: 13870 - protein, 10 aa, Brucella spp.
DADKRASLFP

SEQ ID NO: 13871 - protein, 9 aa, Brucella spp.
YRASGNAPE

SEQ ID NO: 13872 - protein, 10 aa, Brucella spp.
SSDDTQAAKL

SEQ ID NO: 13873 - protein, 23 aa, Brucella spp.
GAMAESAKTHKTDMAKKKVSELT

SEQ ID NO: 13874 - protein, 5 aa, Brucella spp.
ESFKP

SEQ ID NO: 13875 - protein, 9 aa, Brucella spp.
KKGKEEDAV

SEQ ID NO: 13876 - protein, 7 aa, Brucella spp.
KQEPKAS

SEQ ID NO: 13877 - protein, 9 aa, Brucella spp.
GLPSEATYG

SEQ ID NO: 13878 - protein, 7 aa, Brucella spp.
TGWPQKG

SEQ ID NO: 13879 - protein, 8 aa, Brucella spp.
AGPGQRWD

SEQ ID NO: 13880 - protein, 7 aa, Brucella spp.
DNPARNY

SEQ ID NO: 13881 - protein, 6 aa, Brucella spp.
GPSSAL

SEQ ID NO: 13882 - protein, 7 aa, Brucella spp.
NAKGAPS

SEQ ID NO: 13883 - protein, 10 aa, Brucella spp.
SEPNTPRPYR

SEQ ID NO: 13884 - protein, 7 aa, Brucella spp.
IAVGSPS

SEQ ID NO: 13885 - protein, 11 aa, Brucella spp.
HWKTPEGSADF

SEQ ID NO: 13886 - protein, 12 aa, Brucella spp.
EGRMPGSQQAAG

SEQ ID NO: 13887 - protein, 8 aa, Brucella spp.
EQKAEEVR

SEQ ID NO: 13888 - protein, 7 aa, Brucella spp.
DSDGRVK

SEQ ID NO: 13889 - protein, 10 aa, Brucella spp.
NSTAAGAVSG

SEQ ID NO: 13890 - protein, 12 aa, Brucella spp.
LGAATGAIGGKL

SEQ ID NO: 13891 - protein, 4 aa, Brucella spp.
TDVG

SEQ ID NO: 13892 - protein, 7 aa, Brucella spp.
VLQPGSA

SEQ ID NO: 13893 - protein, 5 aa, Brucella spp.
GIGGT

SEQ ID NO: 13894 - protein, 12 aa, Brucella spp.
TSLDEKAENALR

SEQ ID NO: 13895 - protein, 14 aa, Brucella spp.
SSATQTAPTGTSGA

SEQ ID NO: 13896 - protein, 11 aa, Brucella spp.
SAASAPAAAAG

SEQ ID NO: 13897 - protein, 8 aa, Brucella spp.
KKAPGDMK

SEQ ID NO: 13898 - protein, 4 aa, Brucella spp.
KVPP

SEQ ID NO: 13899 - protein, 15 aa, Brucella spp.
AADKSLNDKQKTEHV

SEQ ID NO: 13900 - protein, 8 aa, Brucella spp.
YTAPSADE

SEQ ID NO: 13901 - protein, 13 aa, Brucella spp.
IDSAAKDKKISRD

SEQ ID NO: 13902 - protein, 36 aa, Brucella spp.
AQAATPTAETPAATPSTPAAPVPAAGSAAPASGSVD

SEQ ID NO: 13903 - protein, 9 aa, Brucella spp.
VKKSGQALN

SEQ ID NO: 13904 - protein, 8 aa, Brucella spp.
SSLQHRKE

SEQ ID NO: 13905 - protein, 14 aa, Brucella spp.
QELGYTGDINDSAT

SEQ ID NO: 13906 - protein, 12 aa, Brucella spp.
LKDSGGKLPAGL

SEQ ID NO: 13907 - protein, 8 aa, Brucella spp.
ASAPQARE

SEQ ID NO: 13908 - protein, 9 aa, Brucella spp.
RASYGGQSD

SEQ ID NO: 13909 - protein, 5 aa, Brucella spp.
DREKV

SEQ ID NO: 13910 - protein, 10 aa, Brucella spp.
KMDRGDQVST

SEQ ID NO: 13911 - protein, 7 aa, Brucella spp.
TSTAALG

SEQ ID NO: 13912 - protein, 6 aa, Brucella spp.
LAQRNE

SEQ ID NO: 13913 - protein, 4 aa, Brucella spp.
DAKL

SEQ ID NO: 13914 - protein, 14 aa, Brucella spp.
ASQTRDKDTLTEEG

SEQ ID NO: 13915 - protein, 8 aa, Brucella spp.
PAGIERGA

SEQ ID NO: 13916 - protein, 11 aa, Brucella spp.
NPEVSSVRDSD

SEQ ID NO: 13917 - protein, 11 aa, Brucella spp.
KTLKAERGEKM

SEQ ID NO: 13918 - protein, 10 aa, Brucella spp.
YDPSRAERGD

SEQ ID NO: 13919 - protein, 19 aa, Brucella spp.
ASNVGSPVTLADQRSAPAM

SEQ ID NO: 13920 - protein, 7 aa, Brucella spp.
RLAGEDV

SEQ ID NO: 13921 - protein, 21 aa, Brucella spp.
PMNVPSEKRGLLGKLFGRRAA

SEQ ID NO: 13922 - protein, 5 aa, Brucella spp.
RPASV

SEQ ID NO: 13923 - protein, 5 aa, Brucella spp.
EDDKD

SEQ ID NO: 13924 - protein, 4 aa, Brucella spp.
LSND

SEQ ID NO: 13925 - protein, 10 aa, Brucella spp.
TLKPQEKQLT

SEQ ID NO: 13926 - protein, 6 aa, Brucella spp.
LTPHEE

SEQ ID NO: 13927 - protein, 5 aa, Brucella spp.
AYRWS

SEQ ID NO: 13928 - protein, 7 aa, Brucella spp.
ADDPLKK

SEQ ID NO: 13929 - protein, 7 aa, Brucella spp.
AKLTNTA

SEQ ID NO: 13930 - protein, 8 aa, Brucella spp.
SEEKRQEI

SEQ ID NO: 13931 - protein, 4 aa, Brucella spp.
GLTE

SEQ ID NO: 13932 - protein, 9 aa, Brucella spp.
LSPNADENH

SEQ ID NO: 13933 - protein, 9 aa, Brucella spp.
FSGSGSSYV

SEQ ID NO: 13934 - protein, 28 aa, Brucella spp.
REAEAVQGAPEPVAMTAGKPAKSSDGLD

SEQ ID NO: 13935 - protein, 5 aa, Brucella spp.
EDGKI

SEQ ID NO: 13936 - protein, 4 aa, Brucella spp.
RQAA

SEQ ID NO: 13937 - protein, 7 aa, Brucella spp.
RGDEQLA

SEQ ID NO: 13938 - protein, 9 aa, Brucella spp.
RYQPATPTF

SEQ ID NO: 13939 - protein, 8 aa, Brucella spp.
AGKKQRGE

SEQ ID NO: 13940 - protein, 8 aa, Brucella spp.
MESIGRSI

SEQ ID NO: 13941 - protein, 7 aa, Brucella spp.
LSKRGGG

SEQ ID NO: 13942 - protein, 16 aa, Brucella spp.
EAGAPIKQIENQSSGI

SEQ ID NO: 13943 - protein, 9 aa, Brucella spp.
QLGARQGAG

SEQ ID NO: 13944 - protein, 9 aa, Brucella spp.
KRENADEKI

SEQ ID NO: 13945 - protein, 4 aa, Brucella spp.
RNNE

SEQ ID NO: 13946 - protein, 9 aa, Brucella spp.
QIAKKKINA

SEQ ID NO: 13947 - protein, 9 aa, Brucella spp.
NRANPIDGR

SEQ ID NO: 13948 - protein, 12 aa, Brucella spp.
DAPDFGKTIETS

SEQ ID NO: 13949 - protein, 10 aa, Brucella spp.
VARGNAESHA

SEQ ID NO: 13950 - protein, 6 aa, Brucella spp.
SEEGVD

SEQ ID NO: 13951 - protein, 22 aa, Brucella spp.
IAVETGKSFKGFEKSKYASGEY

SEQ ID NO: 13952 - protein, 9 aa, Brucella spp.
QAWAPATEK

SEQ ID NO: 13953 - protein, 5 aa, Brucella spp.
AIPTQ

SEQ ID NO: 13954 - protein, 8 aa, Brucella spp.
AVPPTGSI

SEQ ID NO: 13955 - protein, 5 aa, Brucella spp.
STSSI

SEQ ID NO: 13956 - protein, 7 aa, Brucella spp.
RKEGKIG

SEQ ID NO: 13957 - protein, 5 aa, Brucella spp.
EIGPE

SEQ ID NO: 13958 - protein, 7 aa, Brucella spp.
ATQHVDQ

SEQ ID NO: 13959 - protein, 8 aa, Brucella spp.
TATTRDIN

SEQ ID NO: 13960 - protein, 12 aa, Brucella spp.
GTQVQGCVSCAL

SEQ ID NO: 13961 - protein, 5 aa, Brucella spp.
TNREG

SEQ ID NO: 13962 - protein, 8 aa, Brucella spp.
ETKPGVGF

SEQ ID NO: 13963 - protein, 13 aa, Brucella spp.
KEWENQKKWNGGW

SEQ ID NO: 13964 - protein, 10 aa, Brucella spp.
KKNGKIEPKM

SEQ ID NO: 13965 - protein, 6 aa, Brucella spp.
PDLPEI

SEQ ID NO: 13966 - protein, 22 aa, Brucella spp.
QTAGESRTMPTARPRSLISGER

SEQ ID NO: 13967 - protein, 12 aa, Brucella spp.
FAKRSKDYNFEG

SEQ ID NO: 13968 - protein, 11 aa, Brucella spp.
PSGAIYKREDD

SEQ ID NO: 13969 - protein, 6 aa, Brucella spp.
SSGKSE

SEQ ID NO: 13970 - protein, 8 aa, Brucella spp.
ESGQPTVC

SEQ ID NO: 13971 - protein, 15 aa, Brucella spp.
RISEAASTANEQDLY

SEQ ID NO: 13972 - protein, 7 aa, Brucella spp.
NDPAVIE

SEQ ID NO: 13973 - protein, 9 aa, Brucella spp.
QARKDGVPD

SEQ ID NO: 13974 - protein, 5 aa, Brucella spp.
KHSPV

SEQ ID NO: 13975 - protein, 20 aa, Brucella spp.
SPLQSAAQAGKLGMDGPLPD

SEQ ID NO: 13976 - protein, 8 aa, Brucella spp.
AGKEEPVI

SEQ ID NO: 13977 - protein, 11 aa, Brucella spp.
REITEDAYDVR

SEQ ID NO: 13978 - protein, 11 aa, Brucella spp.
GCSGGTSTEDL

SEQ ID NO: 13979 - protein, 14 aa, Brucella spp.
KVVQTPTDIFREQV

SEQ ID NO: 13980 - protein, 9 aa, Brucella spp.
PELQAGRAE

SEQ ID NO: 13981 - protein, 13 aa, Brucella spp.
AALEGEKNLSPGV

SEQ ID NO: 13982 - protein, 9 aa, Brucella spp.
GESRDRGQA

SEQ ID NO: 13983 - protein, 5 aa, Brucella spp.
KELPD

SEQ ID NO: 13984 - protein, 7 aa, Brucella spp.
TRSTEEI

SEQ ID NO: 13985 - protein, 11 aa, Brucella spp.
RLRKRQSPYAG

SEQ ID NO: 13986 - protein, 8 aa, Brucella spp.
NAKPDEKL

SEQ ID NO: 13987 - protein, 10 aa, Brucella spp.
QEEDDPDDLA

SEQ ID NO: 13988 - protein, 13 aa, Brucella spp.
FGANAGENACGPD

SEQ ID NO: 13989 - protein, 13 aa, Brucella spp.
REPYTWRSGSSQL

SEQ ID NO: 13990 - protein, 9 aa, Brucella spp.
RASSRPSDT

SEQ ID NO: 13991 - protein, 6 aa, Brucella spp.
AASSYV

SEQ ID NO: 13992 - protein, 15 aa, Brucella spp.
RNHTAAPSHLRAPAE

SEQ ID NO: 13993 - protein, 6 aa, Brucella spp.
KDVPVD

SEQ ID NO: 13994 - protein, 9 aa, Brucella spp.
AARGKQDGL

SEQ ID NO: 13995 - protein, 8 aa, Brucella spp.
RGKDTEEC

SEQ ID NO: 13996 - protein, 12 aa, Brucella spp.
PLGTGSRGCRLD

SEQ ID NO: 13997 - protein, 9 aa, Brucella spp.
GKGETEGHG

SEQ ID NO: 13998 - protein, 8 aa, Brucella spp.
APNSESVT

SEQ ID NO: 13999 - protein, 4 aa, Brucella spp.
SGSL

SEQ ID NO: 14000 - protein, 6 aa, Brucella spp.
AAQQTL

SEQ ID NO: 14001 - protein, 10 aa, Brucella spp.
AIASGSVPTA

SEQ ID NO: 14002 - protein, 7 aa, Brucella spp.
ANGYSDS

SEQ ID NO: 14003 - protein, 11 aa, Brucella spp.
QTVEDVASQVA

SEQ ID NO: 14004 - protein, 19 aa, Brucella spp.
GTPQAQSWNPEEKPRRKAG

SEQ ID NO: 14005 - protein, 4 aa, Brucella spp.
EKRG

SEQ ID NO: 14006 - protein, 4 aa, Brucella spp.
ADGP

SEQ ID NO: 14007 - protein, 10 aa, Brucella spp.
VDAEGRTQTI

SEQ ID NO: 14008 - protein, 11 aa, Brucella spp.
RAPKPPRSAGE

SEQ ID NO: 14009 - protein, 10 aa, Brucella spp.
MRPRQVSRAP

SEQ ID NO: 14010 - protein, 4 aa, Brucella spp.
EPAP

SEQ ID NO: 14011 - protein, 9 aa, Brucella spp.
RAPDDPSDV

SEQ ID NO: 14012 - protein, 4 aa, Brucella spp.
GGAR

SEQ ID NO: 14013 - protein, 5 aa, Brucella spp.
RGEDM

SEQ ID NO: 14014 - protein, 9 aa, Brucella spp.
RRPCVTQGR

SEQ ID NO: 14015 - protein, 19 aa, Brucella spp.
VSATQTAPEGPYGDHTGYY

SEQ ID NO: 14016 - protein, 12 aa, Brucella spp.
TERPPDEPSRLG

SEQ ID NO: 14017 - protein, 7 aa, Brucella spp.
KRYPGQA

SEQ ID NO: 14018 - protein, 4 aa, Brucella spp.
FDAS

SEQ ID NO: 14019 - protein, 5 aa, Brucella spp.
SDTPV

SEQ ID NO: 14020 - protein, 26 aa, Brucella spp.
SPRSGLGGKLGLDATNKIGPETDREW

SEQ ID NO: 14021 - protein, 5 aa, Brucella spp.
PGKPR

SEQ ID NO: 14022 - protein, 7 aa, Brucella spp.
ADAAIEG

SEQ ID NO: 14023 - protein, 4 aa, Brucella spp.
KLDG

SEQ ID NO: 14024 - protein, 4 aa, Brucella spp.
VTGD

SEQ ID NO: 14025 - protein, 13 aa, Brucella spp.
PADLGNGAGPFGP

SEQ ID NO: 14026 - protein, 14 aa, Brucella spp.
LGADAHDREAHSWN

SEQ ID NO: 14027 - protein, 6 aa, Brucella spp.
EPHPTA

SEQ ID NO: 14028 - protein, 7 aa, Brucella spp.
DGGRFDA

SEQ ID NO: 14029 - protein, 8 aa, Brucella spp.
PTGCGKST

SEQ ID NO: 14030 - protein, 19 aa, Brucella spp.
TPASGTVEISGQRLQGLNR

SEQ ID NO: 14031 - protein, 14 aa, Brucella spp.
AGTPKAKAREQARE

SEQ ID NO: 14032 - protein, 4 aa, Brucella spp.
GTFG

SEQ ID NO: 14033 - protein, 7 aa, Brucella spp.
GGQRKRV

SEQ ID NO: 14034 - protein, 5 aa, Brucella spp.
GPLDA

SEQ ID NO: 14035 - protein, 5 aa, Brucella spp.
GPRAR

SEQ ID NO: 14036 - protein, 4 aa, Brucella spp.
PREI

SEQ ID NO: 14037 - protein, 14 aa, Brucella spp.
ATMPSERKGGIPRG

SEQ ID NO: 14038 - protein, 6 aa, Brucella spp.
LGGSYG

SEQ ID NO: 14039 - protein, 6 aa, Brucella spp.
PVSGGP

SEQ ID NO: 14040 - protein, 9 aa, Brucella spp.
ATRGHTGRE

SEQ ID NO: 14041 - protein, 6 aa, Brucella spp.
KGAEGA

SEQ ID NO: 14042 - protein, 7 aa, Brucella spp.
KANAGDT

SEQ ID NO: 14043 - protein, 6 aa, Brucella spp.
GHNVET

SEQ ID NO: 14044 - protein, 15 aa, Brucella spp.
IPDGAEKFKSKINEH

SEQ ID NO: 14045 - protein, 6 aa, Brucella spp.
VNQPGA

SEQ ID NO: 14046 - protein, 8 aa, Brucella spp.
GDKPENLE

SEQ ID NO: 14047 - protein, 20 aa, Brucella spp.
SAKKPKVVQERLDKILAEVK

SEQ ID NO: 14048 - protein, 13 aa, Brucella spp.
CSPAEKQEPATPF

SEQ ID NO: 14049 - protein, 7 aa, Brucella spp.
HPGPKGQ

SEQ ID NO: 14050 - protein, 5 aa, Brucella spp.
EEPKN

SEQ ID NO: 14051 - protein, 12 aa, Brucella spp.
KAPNWDEPGANN

SEQ ID NO: 14052 - protein, 8 aa, Brucella spp.
AVGGMGAK

SEQ ID NO: 14053 - protein, 22 aa, Brucella spp.
EAVPFSDRAAAERFTADNGGRI

SEQ ID NO: 14054 - protein, 16 aa, Brucella spp.
EQTAQHVEPDGESHMH

SEQ ID NO: 14055 - protein, 5 aa, Brucella spp.
IQEGL

SEQ ID NO: 14056 - protein, 12 aa, Brucella spp.
SAPTGSSVAASK

SEQ ID NO: 14057 - protein, 9 aa, Brucella spp.
AATGTGVDA

SEQ ID NO: 14058 - protein, 8 aa, Brucella spp.
RERSTAAG

SEQ ID NO: 14059 - protein, 7 aa, Brucella spp.
GQTIGSA

SEQ ID NO: 14060 - protein, 24 aa, Brucella spp.
GTGQAGALTGMGGMAGNATLSAPA

SEQ ID NO: 14061 - protein, 7 aa, Brucella spp.
TKSYGGF

SEQ ID NO: 14062 - protein, 8 aa, Brucella spp.
HNGAGKTT

SEQ ID NO: 14063 - protein, 5 aa, Brucella spp.
PTKGA

SEQ ID NO: 14064 - protein, 9 aa, Brucella spp.
GEDPAAGAF

SEQ ID NO: 14065 - protein, 4 aa, Brucella spp.
PFGQ

SEQ ID NO: 14066 - protein, 12 aa, Brucella spp.
RRVGTYSKGMRQ

SEQ ID NO: 14067 - protein, 9 aa, Brucella spp.
EPTTGLDPA

SEQ ID NO: 14068 - protein, 6 aa, Brucella spp.
RQEGTT

SEQ ID NO: 14069 - protein, 4 aa, Brucella spp.
ELET

SEQ ID NO: 14070 - protein, 7 aa, Brucella spp.
KVIADGS

SEQ ID NO: 14071 - protein, 9 aa, Brucella spp.
ETEAPAEGK

SEQ ID NO: 14072 - protein, 6 aa, Brucella spp.
GAQARQ

SEQ ID NO: 14073 - protein, 4 aa, Brucella spp.
ESVQ

SEQ ID NO: 14074 - protein, 9 aa, Brucella spp.
IEKAEPGDV

SEQ ID NO: 14075 - protein, 6 aa, Brucella spp.
AGRHEG

SEQ ID NO: 14076 - protein, 8 aa, Brucella spp.
LTGEPGAV

SEQ ID NO: 14077 - protein, 9 aa, Brucella spp.
GLGTGNAIT

SEQ ID NO: 14078 - protein, 4 aa, Brucella spp.
VNAP

SEQ ID NO: 14079 - protein, 10 aa, Brucella spp.
HGSGDNLPDL

SEQ ID NO: 14080 - protein, 9 aa, Brucella spp.
TATGARVEN

SEQ ID NO: 14081 - protein, 8 aa, Brucella spp.
MAETGSGV

SEQ ID NO: 14082 - protein, 6 aa, Brucella spp.
APGAQV

SEQ ID NO: 14083 - protein, 4 aa, Brucella spp.
IRYG

SEQ ID NO: 14084 - protein, 11 aa, Brucella spp.
GIYTNASRKNI

SEQ ID NO: 14085 - protein, 9 aa, Brucella spp.
GNVSRNNSV

SEQ ID NO: 14086 - protein, 8 aa, Brucella spp.
VSEGDRDH

SEQ ID NO: 14087 - protein, 4 aa, Brucella spp.
SIIT

SEQ ID NO: 14088 - protein, 26 aa, Brucella spp.
LQKGEHGVPGEEKVEASAGETARLGP

SEQ ID NO: 14089 - protein, 10 aa, Brucella spp.
KNKFSENSFE

SEQ ID NO: 14090 - protein, 12 aa, Brucella spp.
AGSEGNAMSGNS

SEQ ID NO: 14091 - protein, 29 aa, Brucella spp.
DGRGNYWSDNPAFDLDGDGIADSPYRPND

SEQ ID NO: 14092 - protein, 12 aa, Brucella spp.
PTAQLKESKHND

SEQ ID NO: 14093 - protein, 7 aa, Brucella spp.
PARAADI

SEQ ID NO: 14094 - protein, 21 aa, Brucella spp.
DSIGEPQGEPPIAPVKKGNEL

SEQ ID NO: 14095 - protein, 11 aa, Brucella spp.
FTNATGYSGKP

SEQ ID NO: 14096 - protein, 8 aa, Brucella spp.
GQIKPPQV

SEQ ID NO: 14097 - protein, 8 aa, Brucella spp.
GRLGNAPV

SEQ ID NO: 14098 - protein, 5 aa, Brucella spp.
DAPRA

SEQ ID NO: 14099 - protein, 5 aa, Brucella spp.
DGSVR

SEQ ID NO: 14100 - protein, 20 aa, Brucella spp.
RDAKHDEAAANPETADPEDE

SEQ ID NO: 14101 - protein, 5 aa, Brucella spp.
ASVPS

SEQ ID NO: 14102 - protein, 7 aa, Brucella spp.
KEGYERL

SEQ ID NO: 14103 - protein, 7 aa, Brucella spp.
QLKPGQQ

SEQ ID NO: 14104 - protein, 12 aa, Brucella spp.
DGAYSFKGSGYV

SEQ ID NO: 14105 - protein, 6 aa, Brucella spp.
GQGVRF

SEQ ID NO: 14106 - protein, 6 aa, Brucella spp.
KNHTRI

SEQ ID NO: 14107 - protein, 6 aa, Brucella spp.
DGAPSL

SEQ ID NO: 14108 - protein, 11 aa, Brucella spp.
FGARDKANVSY

SEQ ID NO: 14109 - protein, 28 aa, Brucella spp.
QPEPAPAKPVATADAPRQPQPVGEATAA

SEQ ID NO: 14110 - protein, 7 aa, Brucella spp.
DILGENS

SEQ ID NO: 14111 - protein, 6 aa, Brucella spp.
ECGSPC

SEQ ID NO: 14112 - protein, 5 aa, Brucella spp.
PEGQI

SEQ ID NO: 14113 - protein, 24 aa, Brucella spp.
EKFAARNAPLAAAAERGGGPARPI

SEQ ID NO: 14114 - protein, 14 aa, Brucella spp.
GKPVETPVNPGPAA

SEQ ID NO: 14115 - protein, 4 aa, Brucella spp.
TAAD

SEQ ID NO: 14116 - protein, 8 aa, Brucella spp.
SGEKETMA

SEQ ID NO: 14117 - protein, 20 aa, Brucella spp.
TSYAASQRFGEEMRATGETG

SEQ ID NO: 14118 - protein, 4 aa, Brucella spp.
HEGG

SEQ ID NO: 14119 - protein, 13 aa, Brucella spp.
ASSRRIEARKLPA

SEQ ID NO: 14120 - protein, 8 aa, Brucella spp.
TGSARAGL

SEQ ID NO: 14121 - protein, 9 aa, Brucella spp.
GIVEQSSDD

SEQ ID NO: 14122 - protein, 6 aa, Brucella spp.
VDPAAV

SEQ ID NO: 14123 - protein, 16 aa, Brucella spp.
EGGKPLAVGPSNDRAR

SEQ ID NO: 14124 - protein, 13 aa, Brucella spp.
AGEQAERINTTKA

SEQ ID NO: 14125 - protein, 7 aa, Brucella spp.
ISPEMET

SEQ ID NO: 14126 - protein, 5 aa, Brucella spp.
KPETF

SEQ ID NO: 14127 - protein, 5 aa, Brucella spp.
GSLAR

SEQ ID NO: 14128 - protein, 4 aa, Brucella spp.
KRWD

SEQ ID NO: 14129 - protein, 28 aa, Brucella spp.
DVRAGGENLGGLSKQAAAELGLRPGTAI

SEQ ID NO: 14130 - protein, 16 aa, Brucella spp.
AGGIGTVGARGSEGRI

SEQ ID NO: 14131 - protein, 8 aa, Brucella spp.
TMTTTEQP

SEQ ID NO: 14132 - protein, 10 aa, Brucella spp.
EGGQSAAGAA

SEQ ID NO: 14133 - protein, 17 aa, Brucella spp.
EAEKAAADQGKGLADSL

SEQ ID NO: 14134 - protein, 13 aa, Brucella spp.
AEVEARGGPEKTA

SEQ ID NO: 14135 - protein, 9 aa, Brucella spp.
RAPFADPDA

SEQ ID NO: 14136 - protein, 4 aa, Brucella spp.
TGMD

SEQ ID NO: 14137 - protein, 6 aa, Brucella spp.
RAKGIV

SEQ ID NO: 14138 - protein, 8 aa, Brucella spp.
SGGAARSN

SEQ ID NO: 14139 - protein, 8 aa, Brucella spp.
ASTSPEPV

SEQ ID NO: 14140 - protein, 7 aa, Brucella spp.
ASGAYPD

SEQ ID NO: 14141 - protein, 11 aa, Brucella spp.
GARNRPDARRA

SEQ ID NO: 14142 - protein, 6 aa, Brucella spp.
DENALA

SEQ ID NO: 14143 - protein, 7 aa, Brucella spp.
LGDKAKP

SEQ ID NO: 14144 - protein, 5 aa, Brucella spp.
GSYIG

SEQ ID NO: 14145 - protein, 7 aa, Brucella spp.
EGDPDAW

SEQ ID NO: 14146 - protein, 4 aa, Brucella spp.
PQAK

SEQ ID NO: 14147 - protein, 4 aa, Brucella spp.
DEAL

SEQ ID NO: 14148 - protein, 8 aa, Brucella spp.
SLMEPKEV

SEQ ID NO: 14149 - protein, 7 aa, Brucella spp.
KSGDLGS

SEQ ID NO: 14150 - protein, 6 aa, Brucella spp.
SISGLS

SEQ ID NO: 14151 - protein, 6 aa, Brucella spp.
TGSINL

SEQ ID NO: 14152 - protein, 17 aa, Brucella spp.
AQRRRTAGLSAPSAAGI

SEQ ID NO: 14153 - protein, 12 aa, Brucella spp.
VGGNREAARRAG

SEQ ID NO: 14154 - protein, 4 aa, Brucella spp.
AAGG

SEQ ID NO: 14155 - protein, 14 aa, Brucella spp.
LASSSQQAGTGDVN

SEQ ID NO: 14156 - protein, 9 aa, Brucella spp.
LFGGRGSAW

SEQ ID NO: 14157 - protein, 9 aa, Brucella spp.
SGSSPSTVS

SEQ ID NO: 14158 - protein, 7 aa, Brucella spp.
RISQATA

SEQ ID NO: 14159 - protein, 18 aa, Brucella spp.
HAYTANRQAQGLRHSRSG

SEQ ID NO: 14160 - protein, 14 aa, Brucella spp.
ASRDPEEERETAET

SEQ ID NO: 14161 - protein, 6 aa, Brucella spp.
TDPDGL

SEQ ID NO: 14162 - protein, 17 aa, Brucella spp.
LPGSRAPSVTTDNFAGG

SEQ ID NO: 14163 - protein, 6 aa, Brucella spp.
EAPLQP

SEQ ID NO: 14164 - protein, 9 aa, Brucella spp.
GRNDESTRQ

SEQ ID NO: 14165 - protein, 7 aa, Brucella spp.
LGADPEG

SEQ ID NO: 14166 - protein, 7 aa, Brucella spp.
GYSPANT

SEQ ID NO: 14167 - protein, 6 aa, Brucella spp.
ARHGRL

SEQ ID NO: 14168 - protein, 6 aa, Brucella spp.
HPGEPL

SEQ ID NO: 14169 - protein, 16 aa, Brucella spp.
PRSAITGPLDSFKDIK

SEQ ID NO: 14170 - protein, 10 aa, Brucella spp.
GGTERSKTEM

SEQ ID NO: 14171 - protein, 6 aa, Brucella spp.
PRTMTY

SEQ ID NO: 14172 - protein, 20 aa, Brucella spp.
ADGDFQKNNYPVDAPLTTRK

SEQ ID NO: 14173 - protein, 5 aa, Brucella spp.
TGAEY

SEQ ID NO: 14174 - protein, 10 aa, Brucella spp.
GACQPPEDLP

SEQ ID NO: 14175 - protein, 9 aa, Brucella spp.
WASADKPVV

SEQ ID NO: 14176 - protein, 7 aa, Brucella spp.
YTDAEDY

SEQ ID NO: 14177 - protein, 6 aa, Brucella spp.
SKKTGS

SEQ ID NO: 14178 - protein, 5 aa, Brucella spp.
TRFAD

SEQ ID NO: 14179 - protein, 13 aa, Brucella spp.
VGIEGDESKNPAL

SEQ ID NO: 14180 - protein, 16 aa, Brucella spp.
EQQSARKQDRNQTVRP

SEQ ID NO: 14181 - protein, 5 aa, Brucella spp.
GENEY

SEQ ID NO: 14182 - protein, 8 aa, Brucella spp.
GKVASETT

SEQ ID NO: 14183 - protein, 5 aa, Brucella spp.
KHRAA

SEQ ID NO: 14184 - protein, 16 aa, Brucella spp.
RNPKTGGCSVGVPPDN

SEQ ID NO: 14185 - protein, 22 aa, Brucella spp.
LPAEAKTQQAAMPPNATSPHQA

SEQ ID NO: 14186 - protein, 4 aa, Brucella spp.
QAAG

SEQ ID NO: 14187 - protein, 7 aa, Brucella spp.
DQQKNGH

SEQ ID NO: 14188 - protein, 12 aa, Brucella spp.
AATGPDPLPGNV

SEQ ID NO: 14189 - protein, 8 aa, Brucella spp.
RDFSNAKD

SEQ ID NO: 14190 - protein, 7 aa, Brucella spp.
KQRPLQA

SEQ ID NO: 14191 - protein, 4 aa, Brucella spp.
RRAR

SEQ ID NO: 14192 - protein, 7 aa, Brucella spp.
ARTARTL

SEQ ID NO: 14193 - protein, 6 aa, Brucella spp.
KQLGKN

SEQ ID NO: 14194 - protein, 18 aa, Brucella spp.
SAYDEYSSRIGRIIPKPW

SEQ ID NO: 14195 - protein, 4 aa, Brucella spp.
GVEP

SEQ ID NO: 14196 - protein, 6 aa, Brucella spp.
SLAPGQ

SEQ ID NO: 14197 - protein, 13 aa, Brucella spp.
KGFEAKPEPIGEG

SEQ ID NO: 14198 - protein, 10 aa, Brucella spp.
SKNVGSPDIW

SEQ ID NO: 14199 - protein, 7 aa, Brucella spp.
DMDPPEP

SEQ ID NO: 14200 - protein, 4 aa, Brucella spp.
NMSA

SEQ ID NO: 14201 - protein, 4 aa, Brucella spp.
NRGH

SEQ ID NO: 14202 - protein, 7 aa, Brucella spp.
FDETGKT

SEQ ID NO: 14203 - protein, 13 aa, Brucella spp.
SPAIPAYSPSGNE

SEQ ID NO: 14204 - protein, 8 aa, Brucella spp.
GPTGCGKT

SEQ ID NO: 14205 - protein, 5 aa, Brucella spp.
AADLT

SEQ ID NO: 14206 - protein, 4 aa, Brucella spp.
RAVR

SEQ ID NO: 14207 - protein, 5 aa, Brucella spp.
NPGYQ

SEQ ID NO: 14208 - protein, 7 aa, Brucella spp.
LKPSTRQ

SEQ ID NO: 14209 - protein, 10 aa, Brucella spp.
SEESGLAESR

SEQ ID NO: 14210 - protein, 8 aa, Brucella spp.
HDLEEGVS

SEQ ID NO: 14211 - protein, 8 aa, Brucella spp.
MSQREAAR

SEQ ID NO: 14212 - protein, 8 aa, Brucella spp.
LTDEPDVK

SEQ ID NO: 14213 - protein, 8 aa, Brucella spp.
EETETELY

SEQ ID NO: 14214 - protein, 8 aa, Brucella spp.
LKGRKTTV

SEQ ID NO: 14215 - protein, 7 aa, Brucella spp.
GRKHPNR

SEQ ID NO: 14216 - protein, 6 aa, Brucella spp.
GTQLTA

SEQ ID NO: 14217 - protein, 7 aa, Brucella spp.
RGRAPYN

SEQ ID NO: 14218 - protein, 17 aa, Brucella spp.
GRQRSQKLSGFAQQPAE

SEQ ID NO: 14219 - protein, 10 aa, Brucella spp.
AAGEGQEEED

SEQ ID NO: 14220 - protein, 4 aa, Brucella spp.
PQGV

SEQ ID NO: 14221 - protein, 6 aa, Brucella spp.
PGLAAT

SEQ ID NO: 14222 - protein, 10 aa, Brucella spp.
RRRNNPKAVR

SEQ ID NO: 14223 - protein, 10 aa, Brucella spp.
RFAGDEAAGS

SEQ ID NO: 14224 - protein, 4 aa, Brucella spp.
PSRS

SEQ ID NO: 14225 - protein, 8 aa, Brucella spp.
QGAGTISA

SEQ ID NO: 14226 - protein, 14 aa, Brucella spp.
AAEDVQTPGSPQDY

SEQ ID NO: 14227 - protein, 5 aa, Brucella spp.
QSGSY

SEQ ID NO: 14228 - protein, 7 aa, Brucella spp.
SAEELSR

SEQ ID NO: 14229 - protein, 6 aa, Brucella spp.
KLAPDT

SEQ ID NO: 14230 - protein, 5 aa, Brucella spp.
GSAGR

SEQ ID NO: 14231 - protein, 6 aa, Brucella spp.
TLPTSD

SEQ ID NO: 14232 - protein, 5 aa, Brucella spp.
ASGTG

SEQ ID NO: 14233 - protein, 7 aa, Brucella spp.
GGPATAG

SEQ ID NO: 14234 - protein, 7 aa, Brucella spp.
RGQSGLR

SEQ ID NO: 14235 - protein, 4 aa, Brucella spp.
AIQA

SEQ ID NO: 14236 - protein, 6 aa, Brucella spp.
ERDHCK

SEQ ID NO: 14237 - protein, 13 aa, Brucella spp.
TVKAGKVKPDAVP

SEQ ID NO: 14238 - protein, 7 aa, Brucella spp.
KGGFANP

SEQ ID NO: 14239 - protein, 6 aa, Brucella spp.
RARSHG

SEQ ID NO: 14240 - protein, 4 aa, Brucella spp.
TEKG

SEQ ID NO: 14241 - protein, 14 aa, Brucella spp.
TVAPTGGSKPLLGT

SEQ ID NO: 14242 - protein, 6 aa, Brucella spp.
RRDNPP

SEQ ID NO: 14243 - protein, 6 aa, Brucella spp.
VAARGE

SEQ ID NO: 14244 - protein, 8 aa, Brucella spp.
AGKQLPEG

SEQ ID NO: 14245 - protein, 15 aa, Brucella spp.
DKDGKPTTDPETALE

SEQ ID NO: 14246 - protein, 8 aa, Brucella spp.
GHKGSAIS

SEQ ID NO: 14247 - protein, 6 aa, Brucella spp.
DRTSPE

SEQ ID NO: 14248 - protein, 5 aa, Brucella spp.
TLSPV

SEQ ID NO: 14249 - protein, 11 aa, Brucella spp.
FAAGRPGDPFA

SEQ ID NO: 14250 - protein, 23 aa, Brucella spp.
GARLPSQRRFTARTASQSEGITL

SEQ ID NO: 14251 - protein, 9 aa, Brucella spp.
CKPDRSPDF

SEQ ID NO: 14252 - protein, 7 aa, Brucella spp.
GQELIGD

SEQ ID NO: 14253 - protein, 5 aa, Brucella spp.
QRMEG

SEQ ID NO: 14254 - protein, 8 aa, Brucella spp.
GAVNTASA

SEQ ID NO: 14255 - protein, 7 aa, Brucella spp.
HAQKVGA

SEQ ID NO: 14256 - protein, 9 aa, Brucella spp.
RGSAIAAQK

SEQ ID NO: 14257 - protein, 5 aa, Brucella spp.
AAPDL

SEQ ID NO: 14258 - protein, 7 aa, Brucella spp.
FGGPADM

SEQ ID NO: 14259 - protein, 9 aa, Brucella spp.
ENITSRDDG

SEQ ID NO: 14260 - protein, 7 aa, Brucella spp.
ATGAITG

SEQ ID NO: 14261 - protein, 17 aa, Brucella spp.
AAALGDVDARQRAQELE

SEQ ID NO: 14262 - protein, 5 aa, Brucella spp.
FDEGP

SEQ ID NO: 14263 - protein, 4 aa, Brucella spp.
DKEY

SEQ ID NO: 14264 - protein, 12 aa, Brucella spp.
TDALSESQRGYV

SEQ ID NO: 14265 - protein, 10 aa, Brucella spp.
SHASNQNVRM

SEQ ID NO: 14266 - protein, 6 aa, Brucella spp.
QIPGTR

SEQ ID NO: 14267 - protein, 17 aa, Brucella spp.
PSGKKVGKSIAPSLPTH

SEQ ID NO: 14268 - protein, 4 aa, Brucella spp.
NIGS

SEQ ID NO: 14269 - protein, 5 aa, Brucella spp.
NGAGK

SEQ ID NO: 14270 - protein, 10 aa, Brucella spp.
SDTPRTPAQN

SEQ ID NO: 14271 - protein, 9 aa, Brucella spp.
TAQTQERLA

SEQ ID NO: 14272 - protein, 5 aa, Brucella spp.
QLPNR

SEQ ID NO: 14273 - protein, 11 aa, Brucella spp.
QKKSARDGLSR

SEQ ID NO: 14274 - protein, 11 aa, Brucella spp.
KPVNDTYGHLT

SEQ ID NO: 14275 - protein, 5 aa, Brucella spp.
VARMG

SEQ ID NO: 14276 - protein, 10 aa, Brucella spp.
GGTSKEQTDI

SEQ ID NO: 14277 - protein, 11 aa, Brucella spp.
KPIEVSQHKPV

SEQ ID NO: 14278 - protein, 4 aa, Brucella spp.
REWR

SEQ ID NO: 14279 - protein, 22 aa, Brucella spp.
AMYSAKSKGKNRFEYFEEKQAA

SEQ ID NO: 14280 - protein, 8 aa, Brucella spp.
GLNGPTMR

SEQ ID NO: 14281 - protein, 6 aa, Brucella spp.
WKPDSD

SEQ ID NO: 14282 - protein, 8 aa, Brucella spp.
RATGGAFD

SEQ ID NO: 14283 - protein, 6 aa, Brucella spp.
AGPRVA

SEQ ID NO: 14284 - protein, 6 aa, Brucella spp.
AKGYGV

SEQ ID NO: 14285 - protein, 7 aa, Brucella spp.
LRPDGTP

SEQ ID NO: 14286 - protein, 8 aa, Brucella spp.
DYNRRAPH

SEQ ID NO: 14287 - protein, 8 aa, Brucella spp.
AVATSGDY

SEQ ID NO: 14288 - protein, 16 aa, Brucella spp.
MDPHRGAPLSTPPASV

SEQ ID NO: 14289 - protein, 6 aa, Brucella spp.
CAQADA

SEQ ID NO: 14290 - protein, 9 aa, Brucella spp.
AGSKLAQSL

SEQ ID NO: 14291 - protein, 8 aa, Brucella spp.
ETIRPQPV

SEQ ID NO: 14292 - protein, 13 aa, Brucella spp.
APQAALADNDCNV

SEQ ID NO: 14293 - protein, 8 aa, Brucella spp.
QSRDAVQQ

SEQ ID NO: 14294 - protein, 16 aa, Brucella spp.
LNEAGKPFKAKINPQS

SEQ ID NO: 14295 - protein, 29 aa, Brucella spp.
KGMDDDRDHRRNRQQHGDAPGPLDGVPAN

SEQ ID NO: 14296 - protein, 12 aa, Brucella spp.
IQKGSTPKVQVQ

SEQ ID NO: 14297 - protein, 15 aa, Brucella spp.
ERPRTGDDTRDWGPP

SEQ ID NO: 14298 - protein, 21 aa, Brucella spp.
DEQGNPTREASYYQSANRGKF

SEQ ID NO: 14299 - protein, 7 aa, Brucella spp.
ASPEGQD

SEQ ID NO: 14300 - protein, 8 aa, Brucella spp.
KAGSLAKY

SEQ ID NO: 14301 - protein, 13 aa, Brucella spp.
FGQTGPRAPEPGY

SEQ ID NO: 14302 - protein, 15 aa, Brucella spp.
TGERDDKPGGGPQKV

SEQ ID NO: 14303 - protein, 9 aa, Brucella spp.
RAKTGKGQH

SEQ ID NO: 14304 - protein, 11 aa, Brucella spp.
SGRPPGRYGNA

SEQ ID NO: 14305 - protein, 13 aa, Brucella spp.
PDLPKDPRFTRNS

SEQ ID NO: 14306 - protein, 9 aa, Brucella spp.
TLDEPQVKA

SEQ ID NO: 14307 - protein, 10 aa, Brucella spp.
KLSGTPVEYK

SEQ ID NO: 14308 - protein, 10 aa, Brucella spp.
DDDRLNDLKS

SEQ ID NO: 14309 - protein, 5 aa, Brucella spp.
IERPA

SEQ ID NO: 14310 - protein, 7 aa, Brucella spp.
IDAGATR

SEQ ID NO: 14311 - protein, 7 aa, Brucella spp.
TAGGGKT

SEQ ID NO: 14312 - protein, 10 aa, Brucella spp.
TDNGSGIPAD

SEQ ID NO: 14313 - protein, 8 aa, Brucella spp.
TSKLTDDV

SEQ ID NO: 14314 - protein, 7 aa, Brucella spp.
ALPSIGS

SEQ ID NO: 14315 - protein, 11 aa, Brucella spp.
LKSRPQDADSG

SEQ ID NO: 14316 - protein, 11 aa, Brucella spp.
HLDGPRPTALN

SEQ ID NO: 14317 - protein, 9 aa, Brucella spp.
TDRAEATAI

SEQ ID NO: 14318 - protein, 22 aa, Brucella spp.
AGTDRTPFEMPATGTGAEATLE

SEQ ID NO: 14319 - protein, 7 aa, Brucella spp.
DAERDGV

SEQ ID NO: 14320 - protein, 5 aa, Brucella spp.
FNRGN

SEQ ID NO: 14321 - protein, 6 aa, Brucella spp.
GRPVRD

SEQ ID NO: 14322 - protein, 5 aa, Brucella spp.
HPAKA

SEQ ID NO: 14323 - protein, 14 aa, Brucella spp.
LAQSGIRPATSGAE

SEQ ID NO: 14324 - protein, 42 aa, Brucella spp.
GFGAQQSAPRPANSYSPASWRTAPPAPRSEWSPQTAHPAHRP

SEQ ID NO: 14325 - protein, 11 aa, Brucella spp.
APALRENGQAV

SEQ ID NO: 14326 - protein, 13 aa, Brucella spp.
VPAADARASVAEA

SEQ ID NO: 14327 - protein, 7 aa, Brucella spp.
PLGAARA

SEQ ID NO: 14328 - protein, 4 aa, Brucella spp.
QTED

SEQ ID NO: 14329 - protein, 13 aa, Brucella spp.
PEEDAQRLAGHAE

SEQ ID NO: 14330 - protein, 5 aa, Brucella spp.
QFGPG

SEQ ID NO: 14331 - protein, 4 aa, Brucella spp.
RETP

SEQ ID NO: 14332 - protein, 10 aa, Brucella spp.
IAEHDTADGL

SEQ ID NO: 14333 - protein, 13 aa, Brucella spp.
SVRSGRRLKPEEM

SEQ ID NO: 14334 - protein, 15 aa, Brucella spp.
EATPGSGTCNHGRPT

SEQ ID NO: 14335 - protein, 10 aa, Brucella spp.
VGGAGKTPTA

SEQ ID NO: 14336 - protein, 6 aa, Brucella spp.
RGMKPG

SEQ ID NO: 14337 - protein, 10 aa, Brucella spp.
VSRGYGGNYS

SEQ ID NO: 14338 - protein, 12 aa, Brucella spp.
PGHDGARHVGDE

SEQ ID NO: 14339 - protein, 9 aa, Brucella spp.
LSPDRVKAA

SEQ ID NO: 14340 - protein, 7 aa, Brucella spp.
SRGIGNG

SEQ ID NO: 14341 - protein, 15 aa, Brucella spp.
PAGPLRAPLTDQMRK

SEQ ID NO: 14342 - protein, 6 aa, Brucella spp.
KGNGAD

SEQ ID NO: 14343 - protein, 7 aa, Brucella spp.
ARAGRPI

SEQ ID NO: 14344 - protein, 11 aa, Brucella spp.
LRPSSSATVAG

SEQ ID NO: 14345 - protein, 7 aa, Brucella spp.
IGNPDKF

SEQ ID NO: 14346 - protein, 8 aa, Brucella spp.
RQAGGEVV

SEQ ID NO: 14347 - protein, 6 aa, Brucella spp.
FEPDDI

SEQ ID NO: 14348 - protein, 6 aa, Brucella spp.
PGVPPE

SEQ ID NO: 14349 - protein, 26 aa, Brucella spp.
RASRGKEDRSRRGERYGKSAIARPQG

SEQ ID NO: 14350 - protein, 5 aa, Brucella spp.
SVGET

SEQ ID NO: 14351 - protein, 6 aa, Brucella spp.
GTVTSA

SEQ ID NO: 14352 - protein, 4 aa, Brucella spp.
ADQL

SEQ ID NO: 14353 - protein, 6 aa, Brucella spp.
RMSDRS

SEQ ID NO: 14354 - protein, 5 aa, Brucella spp.
KRPAL

SEQ ID NO: 14355 - protein, 7 aa, Brucella spp.
SELDGER

SEQ ID NO: 14356 - protein, 8 aa, Brucella spp.
ARPVSVSG

SEQ ID NO: 14357 - protein, 13 aa, Brucella spp.
KVDTPPPPSDPQA

SEQ ID NO: 14358 - protein, 5 aa, Brucella spp.
AGRRT

SEQ ID NO: 14359 - protein, 10 aa, Brucella spp.
STHDGEEEIA

SEQ ID NO: 14360 - protein, 7 aa, Brucella spp.
HPDRAPA

SEQ ID NO: 14361 - protein, 13 aa, Brucella spp.
VARRSTGQPIEAD

SEQ ID NO: 14362 - protein, 11 aa, Brucella spp.
LTKEGGHNPLE

SEQ ID NO: 14363 - protein, 6 aa, Brucella spp.
NGGARI

SEQ ID NO: 14364 - protein, 15 aa, Brucella spp.
LPGNRNEPAFSLDEH

SEQ ID NO: 14365 - protein, 12 aa, Brucella spp.
DRAETNQKHGQR

SEQ ID NO: 14366 - protein, 12 aa, Brucella spp.
LSPNEPSQASAG

SEQ ID NO: 14367 - protein, 4 aa, Brucella spp.
TGAR

SEQ ID NO: 14368 - protein, 6 aa, Brucella spp.
SSYRHE

SEQ ID NO: 14369 - protein, 5 aa, Brucella spp.
SHNDA

SEQ ID NO: 14370 - protein, 5 aa, Brucella spp.
ADDII

SEQ ID NO: 14371 - protein, 6 aa, Brucella spp.
FDGAGS

SEQ ID NO: 14372 - protein, 10 aa, Brucella spp.
DSSSNRVRAA

SEQ ID NO: 14373 - protein, 7 aa, Brucella spp.
DGTRKDV

SEQ ID NO: 14374 - protein, 7 aa, Brucella spp.
KKSTTNH

SEQ ID NO: 14375 - protein, 4 aa, Brucella spp.
SEYP

SEQ ID NO: 14376 - protein, 5 aa, Brucella spp.
SEANA

SEQ ID NO: 14377 - protein, 9 aa, Brucella spp.
DVRQRDEDR

SEQ ID NO: 14378 - protein, 7 aa, Brucella spp.
PVTPEPL

SEQ ID NO: 14379 - protein, 33 aa, Brucella spp.
VKPTREGQRIDKSDDGQRAPSPQETAAAPVAAE

SEQ ID NO: 14380 - protein, 7 aa, Brucella spp.
GGGGARG

SEQ ID NO: 14381 - protein, 5 aa, Brucella spp.
GSSIG

SEQ ID NO: 14382 - protein, 9 aa, Brucella spp.
MANGMSGKD

SEQ ID NO: 14383 - protein, 6 aa, Brucella spp.
SFPSNV

SEQ ID NO: 14384 - protein, 7 aa, Brucella spp.
DGDLRSA

SEQ ID NO: 14385 - protein, 12 aa, Brucella spp.
GGPVGPDDHMPT

SEQ ID NO: 14386 - protein, 7 aa, Brucella spp.
SAAVRDE

SEQ ID NO: 14387 - protein, 5 aa, Brucella spp.
EQALD

SEQ ID NO: 14388 - protein, 7 aa, Brucella spp.
GERGEVP

SEQ ID NO: 14389 - protein, 10 aa, Brucella spp.
RAGNRTREFN

SEQ ID NO: 14390 - protein, 13 aa, Brucella spp.
GASDPKGGGIEHG

SEQ ID NO: 14391 - protein, 16 aa, Brucella spp.
VSSPTYGTDKSAGAQL

SEQ ID NO: 14392 - protein, 71 aa, Brucella spp.
ASFGQGKKKERIDYKPRPDLVRPAPGDKGYLPAPQQSLASSSDPNWPESPEQRRKRVRDEITAHRDDPNYV

SEQ ID NO: 14393 - protein, 7 aa, Brucella spp.
APVADNI

SEQ ID NO: 14394 - protein, 26 aa, Brucella spp.
TALPRGNSRREDYASRTPTSDPAKVA

SEQ ID NO: 14395 - protein, 16 aa, Brucella spp.
AARAQQNQGSATTRRY

SEQ ID NO: 14396 - protein, 47 aa, Brucella spp.
SEPPLAYRQPASTAAVGELGPDEAQKERERKKAASGSRGWRDYLPWN

SEQ ID NO: 14397 - protein, 5 aa, Brucella spp.
LPQRE

SEQ ID NO: 14398 - protein, 8 aa, Brucella spp.
REQAKDRP

SEQ ID NO: 14399 - protein, 7 aa, Brucella spp.
GPPYANG

SEQ ID NO: 14400 - protein, 4 aa, Brucella spp.
SNYV

SEQ ID NO: 14401 - protein, 14 aa, Brucella spp.
KYRAAGKNKDEVPI

SEQ ID NO: 14402 - protein, 4 aa, Brucella spp.
ENPY

SEQ ID NO: 14403 - protein, 9 aa, Brucella spp.
SGQLYRGSK

SEQ ID NO: 14404 - protein, 12 aa, Brucella spp.
GEVATENDLSGS

SEQ ID NO: 14405 - protein, 6 aa, Brucella spp.
WTIPGN

SEQ ID NO: 14406 - protein, 8 aa, Brucella spp.
RAVSYSSR

SEQ ID NO: 14407 - protein, 11 aa, Brucella spp.
AENDFGPRPGE

SEQ ID NO: 14408 - protein, 6 aa, Brucella spp.
VSAEEL

SEQ ID NO: 14409 - protein, 6 aa, Brucella spp.
KGFGGG

SEQ ID NO: 14410 - protein, 11 aa, Brucella spp.
DHVTDDAGTGF

SEQ ID NO: 14411 - protein, 8 aa, Brucella spp.
APSHGRED

SEQ ID NO: 14412 - protein, 11 aa, Brucella spp.
RQLEARGIDPN

SEQ ID NO: 14413 - protein, 34 aa, Brucella spp.
DGFYTKDAPGFGPDREGGPARVIDDNGKKGDANK

SEQ ID NO: 14414 - protein, 7 aa, Brucella spp.
SYPHSWR

SEQ ID NO: 14415 - protein, 9 aa, Brucella spp.
LGDGTTLRS

SEQ ID NO: 14416 - protein, 8 aa, Brucella spp.
PTAGQTRL

SEQ ID NO: 14417 - protein, 6 aa, Brucella spp.
GNILQD

SEQ ID NO: 14418 - protein, 7 aa, Brucella spp.
EKEGADA

SEQ ID NO: 14419 - protein, 7 aa, Brucella spp.
RAGEGWT

SEQ ID NO: 14420 - protein, 6 aa, Brucella spp.
GSTHTF

SEQ ID NO: 14421 - protein, 6 aa, Brucella spp.
DRPDLK

SEQ ID NO: 14422 - protein, 7 aa, Brucella spp.
EGSDQHR

SEQ ID NO: 14423 - protein, 11 aa, Brucella spp.
SCGTRGRAPYN

SEQ ID NO: 14424 - protein, 25 aa, Brucella spp.
EHGKKMSKSLGNTVTPQDVIKESGA

SEQ ID NO: 14425 - protein, 8 aa, Brucella spp.
HDEGENVA

SEQ ID NO: 14426 - protein, 4 aa, Brucella spp.
SGYD

SEQ ID NO: 14427 - protein, 8 aa, Brucella spp.
APSSIRRK

SEQ ID NO: 14428 - protein, 8 aa, Brucella spp.
FRPTPAEW

SEQ ID NO: 14429 - protein, 12 aa, Brucella spp.
ERADKRIGSSLE

SEQ ID NO: 14430 - protein, 8 aa, Brucella spp.
KSLSDSLE

SEQ ID NO: 14431 - protein, 11 aa, Brucella spp.
VSDAAAPEGAF

SEQ ID NO: 14432 - protein, 11 aa, Brucella spp.
PERAKGEKCAR

SEQ ID NO: 14433 - protein, 29 aa, Brucella spp.
TDVGADPEFPEVSARDAAALRELQALGKL

SEQ ID NO: 14434 - protein, 7 aa, Brucella spp.
TEGLPPA

SEQ ID NO: 14435 - protein, 8 aa, Brucella spp.
AERESRPA

SEQ ID NO: 14436 - protein, 15 aa, Brucella spp.
QDQPVDRLTDAAEKA

SEQ ID NO: 14437 - protein, 8 aa, Brucella spp.
FSQRSAED

SEQ ID NO: 14438 - protein, 8 aa, Brucella spp.
KGRRGTPE

SEQ ID NO: 14439 - protein, 7 aa, Brucella spp.
GKKAGFS

SEQ ID NO: 14440 - protein, 5 aa, Brucella spp.
TDEGG

SEQ ID NO: 14441 - protein, 7 aa, Brucella spp.
EGEVAEA

SEQ ID NO: 14442 - protein, 5 aa, Brucella spp.
GRTLG

SEQ ID NO: 14443 - protein, 6 aa, Brucella spp.
APQTSL

SEQ ID NO: 14444 - protein, 14 aa, Brucella spp.
FGRRPTVDDEGAPL

SEQ ID NO: 14445 - protein, 6 aa, Brucella spp.
LYGKTA

SEQ ID NO: 14446 - protein, 8 aa, Brucella spp.
KQDEAQAR

SEQ ID NO: 14447 - protein, 12 aa, Brucella spp.
PISGLDRMLSFN

SEQ ID NO: 14448 - protein, 7 aa, Brucella spp.
GETSFAP

SEQ ID NO: 14449 - protein, 6 aa, Brucella spp.
RARAKG

SEQ ID NO: 14450 - protein, 8 aa, Brucella spp.
NSPRPHPG

SEQ ID NO: 14451 - protein, 5 aa, Brucella spp.
PEDAY

SEQ ID NO: 14452 - protein, 6 aa, Brucella spp.
TSGDVT

SEQ ID NO: 14453 - protein, 9 aa, Brucella spp.
DEVETPEDY

SEQ ID NO: 14454 - protein, 8 aa, Brucella spp.
REYGQLGG

SEQ ID NO: 14455 - protein, 7 aa, Brucella spp.
GKPHRPI

SEQ ID NO: 14456 - protein, 9 aa, Brucella spp.
IRGGSVDKS

SEQ ID NO: 14457 - protein, 9 aa, Brucella spp.
TDVKGAADF

SEQ ID NO: 14458 - protein, 5 aa, Brucella spp.
AVNGD

SEQ ID NO: 14459 - protein, 12 aa, Brucella spp.
GHRPIASLHALV

SEQ ID NO: 14460 - protein, 9 aa, Brucella spp.
ESEAKTAGG

SEQ ID NO: 14461 - protein, 12 aa, Brucella spp.
DTAKEKPQEGEV

SEQ ID NO: 14462 - protein, 11 aa, Brucella spp.
AGAGARDEAGK

SEQ ID NO: 14463 - protein, 9 aa, Brucella spp.
SGTEVKIGG

SEQ ID NO: 14464 - protein, 4 aa, Brucella spp.
GPID

SEQ ID NO: 14465 - protein, 8 aa, Brucella spp.
GAQTQRSL

SEQ ID NO: 14466 - protein, 7 aa, Brucella spp.
AAAETNI

SEQ ID NO: 14467 - protein, 4 aa, Brucella spp.
VIEG

SEQ ID NO: 14468 - protein, 12 aa, Brucella spp.
TGSGTQSNMNAN

SEQ ID NO: 14469 - protein, 12 aa, Brucella spp.
GEMGSKKPIHPN

SEQ ID NO: 14470 - protein, 12 aa, Brucella spp.
NMSQSSNDSFPT

SEQ ID NO: 14471 - protein, 5 aa, Brucella spp.
VKEEA

SEQ ID NO: 14472 - protein, 12 aa, Brucella spp.
RTHTQDATPVTL

SEQ ID NO: 14473 - protein, 4 aa, Brucella spp.
FSGY

SEQ ID NO: 14474 - protein, 14 aa, Brucella spp.
GGTAVGTGLNAPVG

SEQ ID NO: 14475 - protein, 8 aa, Brucella spp.
KTAPNKFE

SEQ ID NO: 14476 - protein, 10 aa, Brucella spp.
GSGPRSGLGE

SEQ ID NO: 14477 - protein, 22 aa, Brucella spp.
SLPENEPGSSIMPGKVNPTQAE

SEQ ID NO: 14478 - protein, 4 aa, Brucella spp.
NQTA

SEQ ID NO: 14479 - protein, 5 aa, Brucella spp.
ASQGH

SEQ ID NO: 14480 - protein, 8 aa, Brucella spp.
GIEPNTAR

SEQ ID NO: 14481 - protein, 4 aa, Brucella spp.
AIGY

SEQ ID NO: 14482 - protein, 17 aa, Brucella spp.
ARIAKTAHKNGTTLREE

SEQ ID NO: 14483 - protein, 8 aa, Brucella spp.
LVSEEDYD

SEQ ID NO: 14484 - protein, 11 aa, Brucella spp.
HTETSSQKNYG

SEQ ID NO: 14485 - protein, 8 aa, Brucella spp.
KPETAASR

SEQ ID NO: 14486 - protein, 4 aa, Brucella spp.
SLGT

SEQ ID NO: 14487 - protein, 11 aa, Brucella spp.
ATDATVNAEAD

SEQ ID NO: 14488 - protein, 20 aa, Brucella spp.
PPDVQEDEPALSDKKEGSAW

SEQ ID NO: 14489 - protein, 12 aa, Brucella spp.
PTVAGLSETDAA

SEQ ID NO: 14490 - protein, 9 aa, Brucella spp.
GSHTSQGSG

SEQ ID NO: 14491 - protein, 6 aa, Brucella spp.
RLKENT

SEQ ID NO: 14492 - protein, 16 aa, Brucella spp.
PDDDRNYRARVEGEDD

SEQ ID NO: 14493 - protein, 4 aa, Brucella spp.
LGYG

SEQ ID NO: 14494 - protein, 5 aa, Brucella spp.
GVTGE

SEQ ID NO: 14495 - protein, 5 aa, Brucella spp.
RQRHG

SEQ ID NO: 14496 - protein, 13 aa, Brucella spp.
GATEGAPAAGSAD

SEQ ID NO: 14497 - protein, 9 aa, Brucella spp.
TSTGSTLRA

SEQ ID NO: 14498 - protein, 9 aa, Brucella spp.
RRSHTSRRV

SEQ ID NO: 14499 - protein, 4 aa, Brucella spp.
AREA

SEQ ID NO: 14500 - protein, 7 aa, Brucella spp.
ENENGDS

SEQ ID NO: 14501 - protein, 7 aa, Brucella spp.
AATPKRY

SEQ ID NO: 14502 - protein, 8 aa, Brucella spp.
QRRDGAAE

SEQ ID NO: 14503 - protein, 16 aa, Brucella spp.
DLGAADEAASDARSLA

SEQ ID NO: 14504 - protein, 5 aa, Brucella spp.
APDAP

SEQ ID NO: 14505 - protein, 4 aa, Brucella spp.
LPQG

SEQ ID NO: 14506 - protein, 12 aa, Brucella spp.
LTGTQRRDPLPE

SEQ ID NO: 14507 - protein, 4 aa, Brucella spp.
GDEI

SEQ ID NO: 14508 - protein, 12 aa, Brucella spp.
GISPGAGRTPVE

SEQ ID NO: 14509 - protein, 10 aa, Brucella spp.
ARADAIAQAG

SEQ ID NO: 14510 - protein, 16 aa, Brucella spp.
DASNRQDGVLAGGGRY

SEQ ID NO: 14511 - protein, 7 aa, Brucella spp.
PDDLRAA

SEQ ID NO: 14512 - protein, 9 aa, Brucella spp.
PDQDRPNEG

SEQ ID NO: 14513 - protein, 5 aa, Brucella spp.
DDDEQ

SEQ ID NO: 14514 - protein, 9 aa, Brucella spp.
TLPKPYRSY

SEQ ID NO: 14515 - protein, 9 aa, Brucella spp.
NEKPGPGRF

SEQ ID NO: 14516 - protein, 11 aa, Brucella spp.
DTVGAPNVSAD

SEQ ID NO: 14517 - protein, 10 aa, Brucella spp.
LEGEGNAAKR

SEQ ID NO: 14518 - protein, 6 aa, Brucella spp.
KFGPEG

SEQ ID NO: 14519 - protein, 19 aa, Brucella spp.
GRLDESGDFTKGAQLPEAA

SEQ ID NO: 14520 - protein, 11 aa, Brucella spp.
AAGGADGAQTI

SEQ ID NO: 14521 - protein, 12 aa, Brucella spp.
AGNAKGEEGVQE

SEQ ID NO: 14522 - protein, 7 aa, Brucella spp.
TNEDGQK

SEQ ID NO: 14523 - protein, 8 aa, Brucella spp.
VGGGGRYD

SEQ ID NO: 14524 - protein, 9 aa, Brucella spp.
RGEPVPATG

SEQ ID NO: 14525 - protein, 6 aa, Brucella spp.
VSDTVG

SEQ ID NO: 14526 - protein, 7 aa, Brucella spp.
DTQNLSR

SEQ ID NO: 14527 - protein, 6 aa, Brucella spp.
GSGMKA

SEQ ID NO: 14528 - protein, 6 aa, Brucella spp.
YADRRA

SEQ ID NO: 14529 - protein, 10 aa, Brucella spp.
GSQEREAGEV

SEQ ID NO: 14530 - protein, 9 aa, Brucella spp.
GKRLSAEIE

SEQ ID NO: 14531 - protein, 10 aa, Brucella spp.
WRESRPAQIT

SEQ ID NO: 14532 - protein, 7 aa, Brucella spp.
WPPHYPS

SEQ ID NO: 14533 - protein, 6 aa, Brucella spp.
SSDFAN

SEQ ID NO: 14534 - protein, 5 aa, Brucella spp.
NHIPQ

SEQ ID NO: 14535 - protein, 12 aa, Brucella spp.
NDEAVSAVSEAL

SEQ ID NO: 14536 - protein, 17 aa, Brucella spp.
YGNEEGVGKAINGSGIA

SEQ ID NO: 14537 - protein, 9 aa, Brucella spp.
NSDQGYEST

SEQ ID NO: 14538 - protein, 4 aa, Brucella spp.
FDTS

SEQ ID NO: 14539 - protein, 5 aa, Brucella spp.
KLGTD

SEQ ID NO: 14540 - protein, 7 aa, Brucella spp.
EEGRVKS

SEQ ID NO: 14541 - protein, 5 aa, Brucella spp.
SGVTP

SEQ ID NO: 14542 - protein, 4 aa, Brucella spp.
IATE

SEQ ID NO: 14543 - protein, 7 aa, Brucella spp.
WSPLGQG

SEQ ID NO: 14544 - protein, 6 aa, Brucella spp.
LEDPTL

SEQ ID NO: 14545 - protein, 11 aa, Brucella spp.
KSIAEKHAKSV

SEQ ID NO: 14546 - protein, 6 aa, Brucella spp.
ITPARI

SEQ ID NO: 14547 - protein, 7 aa, Brucella spp.
GTDHDAI

SEQ ID NO: 14548 - protein, 13 aa, Brucella spp.
DGRIGPNPSVFSA

SEQ ID NO: 14549 - protein, 4 aa, Brucella spp.
DPGV

SEQ ID NO: 14550 - protein, 8 aa, Brucella spp.
NELDSPRG

SEQ ID NO: 14551 - protein, 9 aa, Brucella spp.
ENGRPADEE

SEQ ID NO: 14552 - protein, 4 aa, Brucella spp.
LGKP

SEQ ID NO: 14553 - protein, 21 aa, Brucella spp.
PQSLPAMPAATNAVRGEKRGR

SEQ ID NO: 14554 - protein, 5 aa, Brucella spp.
NPGIN

SEQ ID NO: 14555 - protein, 9 aa, Brucella spp.
ATPKGEGCC

SEQ ID NO: 14556 - protein, 7 aa, Brucella spp.
REEQARH

SEQ ID NO: 14557 - protein, 5 aa, Brucella spp.
IETGG

SEQ ID NO: 14558 - protein, 6 aa, Brucella spp.
GCGTTI

SEQ ID NO: 14559 - protein, 12 aa, Brucella spp.
PAYKDKAARVSA

SEQ ID NO: 14560 - protein, 10 aa, Brucella spp.
LPEPDAPKTL

SEQ ID NO: 14561 - protein, 6 aa, Brucella spp.
IVREPK

SEQ ID NO: 14562 - protein, 4 aa, Brucella spp.
KEPL

SEQ ID NO: 14563 - protein, 4 aa, Brucella spp.
AGTY

SEQ ID NO: 14564 - protein, 14 aa, Brucella spp.
KLRDRKVKNIEATG

SEQ ID NO: 14565 - protein, 5 aa, Brucella spp.
ATGSD

SEQ ID NO: 14566 - protein, 13 aa, Brucella spp.
GGPTPQALEKAGA

SEQ ID NO: 14567 - protein, 6 aa, Brucella spp.
EPDAGV

SEQ ID NO: 14568 - protein, 4 aa, Brucella spp.
LTAH

SEQ ID NO: 14569 - protein, 15 aa, Brucella spp.
PRGAGTSLSGGSMPL

SEQ ID NO: 14570 - protein, 8 aa, Brucella spp.
APDPSSQI

SEQ ID NO: 14571 - protein, 9 aa, Brucella spp.
GNVAENAGG

SEQ ID NO: 14572 - protein, 6 aa, Brucella spp.
HLDSEA

SEQ ID NO: 14573 - protein, 6 aa, Brucella spp.
KPETAR

SEQ ID NO: 14574 - protein, 8 aa, Brucella spp.
PSSEQAGQ

SEQ ID NO: 14575 - protein, 4 aa, Brucella spp.
IKAA

SEQ ID NO: 14576 - protein, 5 aa, Brucella spp.
GPPVE

SEQ ID NO: 14577 - protein, 17 aa, Brucella spp.
LQNGSTTCTLSQSEEQR

SEQ ID NO: 14578 - protein, 5 aa, Brucella spp.
AAFPA

SEQ ID NO: 14579 - protein, 6 aa, Brucella spp.
IPRKEL

SEQ ID NO: 14580 - protein, 4 aa, Brucella spp.
GDGN

SEQ ID NO: 14581 - protein, 13 aa, Brucella spp.
NNPGELEAAEDFG

SEQ ID NO: 14582 - protein, 8 aa, Brucella spp.
TGEHGVGI

SEQ ID NO: 14583 - protein, 5 aa, Brucella spp.
DLDQQ

SEQ ID NO: 14584 - protein, 10 aa, Brucella spp.
GGDRLPGERE

SEQ ID NO: 14585 - protein, 8 aa, Brucella spp.
TSRHGGGT

SEQ ID NO: 14586 - protein, 6 aa, Brucella spp.
HKATAD

SEQ ID NO: 14587 - protein, 7 aa, Brucella spp.
RATPADR

SEQ ID NO: 14588 - protein, 12 aa, Brucella spp.
KAHGADDFATEA

SEQ ID NO: 14589 - protein, 11 aa, Brucella spp.
AGNPQAAREAV

SEQ ID NO: 14590 - protein, 7 aa, Brucella spp.
NDERERV

SEQ ID NO: 14591 - protein, 18 aa, Brucella spp.
RQRAGSKELKEIREDESE

SEQ ID NO: 14592 - protein, 17 aa, Brucella spp.
AGNQTAPTDGYGISSAH

SEQ ID NO: 14593 - protein, 4 aa, Brucella spp.
FPGQ

SEQ ID NO: 14594 - protein, 6 aa, Brucella spp.
ESDSVN

SEQ ID NO: 14595 - protein, 17 aa, Brucella spp.
ETNIQPVSQEEETNLRK

SEQ ID NO: 14596 - protein, 6 aa, Brucella spp.
TKEFSN

SEQ ID NO: 14597 - protein, 10 aa, Brucella spp.
QGADIESGKK

SEQ ID NO: 14598 - protein, 12 aa, Brucella spp.
QIGEGAKNMVGP

SEQ ID NO: 14599 - protein, 19 aa, Brucella spp.
HSGSVEGYKYSDANKNSGI

SEQ ID NO: 14600 - protein, 7 aa, Brucella spp.
KPREVIP

SEQ ID NO: 14601 - protein, 6 aa, Brucella spp.
KDEGKI

SEQ ID NO: 14602 - protein, 6 aa, Brucella spp.
REETRH

SEQ ID NO: 14603 - protein, 11 aa, Brucella spp.
DHEGDTANDAV

SEQ ID NO: 14604 - protein, 18 aa, Brucella spp.
PAALTSRLGPDGHPARGG

SEQ ID NO: 14605 - protein, 4 aa, Brucella spp.
RTSR

SEQ ID NO: 14606 - protein, 6 aa, Brucella spp.
KEGRTG

SEQ ID NO: 14607 - protein, 11 aa, Brucella spp.
HSNGRHAVTER

SEQ ID NO: 14608 - protein, 16 aa, Brucella spp.
DMSNPAAKTQPAVPHG

SEQ ID NO: 14609 - protein, 7 aa, Brucella spp.
IRGKPPV

SEQ ID NO: 14610 - protein, 6 aa, Brucella spp.
IDDGEG

SEQ ID NO: 14611 - protein, 13 aa, Brucella spp.
ANGPVAMEARALW

SEQ ID NO: 14612 - protein, 7 aa, Brucella spp.
ETGSITH

SEQ ID NO: 14613 - protein, 7 aa, Brucella spp.
ASARVRG

SEQ ID NO: 14614 - protein, 6 aa, Brucella spp.
ITPAGR

SEQ ID NO: 14615 - protein, 6 aa, Brucella spp.
ASAAKR

SEQ ID NO: 14616 - protein, 4 aa, Brucella spp.
LPAH

SEQ ID NO: 14617 - protein, 6 aa, Brucella spp.
LAADTG

SEQ ID NO: 14618 - protein, 11 aa, Brucella spp.
KPPFEYSNGSN

SEQ ID NO: 14619 - protein, 10 aa, Brucella spp.
YASSVNERES

SEQ ID NO: 14620 - protein, 16 aa, Brucella spp.
KKSDTKTLPLATEPAL

SEQ ID NO: 14621 - protein, 32 aa, Brucella spp.
NALSRLSETVAEKGVGSASAPQAVPAAPGASF

SEQ ID NO: 14622 - protein, 28 aa, Brucella spp.
MTGSVSQKLQAAEATSIQGIKGDAPVRD

SEQ ID NO: 14623 - protein, 5 aa, Brucella spp.
AEQSL

SEQ ID NO: 14624 - protein, 10 aa, Brucella spp.
ASGLSAQSTR

SEQ ID NO: 14625 - protein, 19 aa, Brucella spp.
IANAQSTARTADTDPYRRK

SEQ ID NO: 14626 - protein, 10 aa, Brucella spp.
ELEQGTGAAE

SEQ ID NO: 14627 - protein, 10 aa, Brucella spp.
EVGKDTSPFI

SEQ ID NO: 14628 - protein, 13 aa, Brucella spp.
YDPSHPAADARGY

SEQ ID NO: 14629 - protein, 9 aa, Brucella spp.
REANRSYEA

SEQ ID NO: 14630 - protein, 16 aa, Brucella spp.
TVAGNVANANTPDFRA

SEQ ID NO: 14631 - protein, 6 aa, Brucella spp.
LTMTAT

SEQ ID NO: 14632 - protein, 27 aa, Brucella spp.
EADGIAATRLRPDDVTEQTHSGNTVDV

SEQ ID NO: 14633 - protein, 4 aa, Brucella spp.
IARE

SEQ ID NO: 14634 - protein, 4 aa, Brucella spp.
GATD

SEQ ID NO: 14635 - protein, 7 aa, Brucella spp.
GVPADDL

SEQ ID NO: 14636 - protein, 10 aa, Brucella spp.
RSCPTGQAIA

SEQ ID NO: 14637 - protein, 12 aa, Brucella spp.
FDSTPKGNIGPV

SEQ ID NO: 14638 - protein, 4 aa, Brucella spp.
NGRT

SEQ ID NO: 14639 - protein, 5 aa, Brucella spp.
TGMRN

SEQ ID NO: 14640 - protein, 6 aa, Brucella spp.
VTPMTD

SEQ ID NO: 14641 - protein, 24 aa, Brucella spp.
SQSRGRAGNISSTIVDQGSDAVRD

SEQ ID NO: 14642 - protein, 5 aa, Brucella spp.
LQSEG

SEQ ID NO: 14643 - protein, 9 aa, Brucella spp.
TGGSGLADG

SEQ ID NO: 14644 - protein, 17 aa, Brucella spp.
GKNVAAAEAAGAPVKGR

SEQ ID NO: 14645 - protein, 6 aa, Brucella spp.
CSQMTN

SEQ ID NO: 14646 - protein, 9 aa, Brucella spp.
AYKAKAPAL

SEQ ID NO: 14647 - protein, 5 aa, Brucella spp.
AINDA

SEQ ID NO: 14648 - protein, 7 aa, Brucella spp.
SGDALPP

SEQ ID NO: 14649 - protein, 6 aa, Brucella spp.
MPPEAL

SEQ ID NO: 14650 - protein, 12 aa, Brucella spp.
QERFGGERASAA

SEQ ID NO: 14651 - protein, 4 aa, Brucella spp.
LEAE

SEQ ID NO: 14652 - protein, 9 aa, Brucella spp.
GGETSGAVT

SEQ ID NO: 14653 - protein, 5 aa, Brucella spp.
PQIAP

SEQ ID NO: 14654 - protein, 6 aa, Brucella spp.
SGNFGT

SEQ ID NO: 14655 - protein, 4 aa, Brucella spp.
AGFG

SEQ ID NO: 14656 - protein, 11 aa, Brucella spp.
PGDWAAGERGM

SEQ ID NO: 14657 - protein, 11 aa, Brucella spp.
AISGREQEFRD

SEQ ID NO: 14658 - protein, 12 aa, Brucella spp.
ITEGLDRKACEE

SEQ ID NO: 14659 - protein, 5 aa, Brucella spp.
KLAPH

SEQ ID NO: 14660 - protein, 5 aa, Brucella spp.
NTRNM

SEQ ID NO: 14661 - protein, 5 aa, Brucella spp.
NRPNV

SEQ ID NO: 14662 - protein, 12 aa, Brucella spp.
VPDRHEPDEGEL

SEQ ID NO: 14663 - protein, 10 aa, Brucella spp.
YNPRGKTESG

SEQ ID NO: 14664 - protein, 9 aa, Brucella spp.
LEEQGRALS

SEQ ID NO: 14665 - protein, 5 aa, Brucella spp.
AAIGQ

SEQ ID NO: 14666 - protein, 5 aa, Brucella spp.
GTTTL

SEQ ID NO: 14667 - protein, 20 aa, Brucella spp.
GGEVERENQSCVGSAAGEAI

SEQ ID NO: 14668 - protein, 16 aa, Brucella spp.
SSFGARGVSTPSENKI

SEQ ID NO: 14669 - protein, 7 aa, Brucella spp.
DSSKYGL

SEQ ID NO: 14670 - protein, 15 aa, Brucella spp.
DAGLPENARETITQR

SEQ ID NO: 14671 - protein, 9 aa, Brucella spp.
TDPTEARYA

SEQ ID NO: 14672 - protein, 6 aa, Brucella spp.
TDRRTA

SEQ ID NO: 14673 - protein, 4 aa, Brucella spp.
AGSR

SEQ ID NO: 14674 - protein, 5 aa, Brucella spp.
IAPPG

SEQ ID NO: 14675 - protein, 10 aa, Brucella spp.
YGAGREHARG

SEQ ID NO: 14676 - protein, 7 aa, Brucella spp.
NGMPDGK

SEQ ID NO: 14677 - protein, 7 aa, Brucella spp.
TGPAGAG

SEQ ID NO: 14678 - protein, 7 aa, Brucella spp.
SYSGPGR

SEQ ID NO: 14679 - protein, 4 aa, Brucella spp.
PGDG

SEQ ID NO: 14680 - protein, 5 aa, Brucella spp.
KSAYD

SEQ ID NO: 14681 - protein, 7 aa, Brucella spp.
VKPISED

SEQ ID NO: 14682 - protein, 15 aa, Brucella spp.
ASVAKGTGAAAGAVI

SEQ ID NO: 14683 - protein, 7 aa, Brucella spp.
TGRLDGT

SEQ ID NO: 14684 - protein, 6 aa, Brucella spp.
MNPEDI

SEQ ID NO: 14685 - protein, 6 aa, Brucella spp.
RAGGAK

SEQ ID NO: 14686 - protein, 8 aa, Brucella spp.
ALPGGGPI

SEQ ID NO: 14687 - protein, 5 aa, Brucella spp.
PDYYD

SEQ ID NO: 14688 - protein, 4 aa, Brucella spp.
YGPA

SEQ ID NO: 14689 - protein, 5 aa, Brucella spp.
KTNHD

SEQ ID NO: 14690 - protein, 6 aa, Brucella spp.
GDPASV

SEQ ID NO: 14691 - protein, 9 aa, Brucella spp.
GDGADPVQC

SEQ ID NO: 14692 - protein, 9 aa, Brucella spp.
GHAAGSRAI

SEQ ID NO: 14693 - protein, 7 aa, Brucella spp.
EPRPDNQ

SEQ ID NO: 14694 - protein, 7 aa, Brucella spp.
SHGEYRA

SEQ ID NO: 14695 - protein, 5 aa, Brucella spp.
KNLTR

SEQ ID NO: 14696 - protein, 16 aa, Brucella spp.
AAARKEGMKKPLSKGD

SEQ ID NO: 14697 - protein, 10 aa, Brucella spp.
NPANKAERKI

SEQ ID NO: 14698 - protein, 10 aa, Brucella spp.
LDRSEQKTVR

SEQ ID NO: 14699 - protein, 48 aa, Brucella spp.
FRPSEQVAPASEVDKTMTGSVMSNGKGLPGAGKGEGEIGDGRGQPFPK

SEQ ID NO: 14700 - protein, 6 aa, Brucella spp.
LLPDGS

SEQ ID NO: 14701 - protein, 7 aa, Brucella spp.
GRGAGTW

SEQ ID NO: 14702 - protein, 14 aa, Brucella spp.
QLTTSSGDIIDMRR

SEQ ID NO: 14703 - protein, 5 aa, Brucella spp.
DTGRA

SEQ ID NO: 14704 - protein, 7 aa, Brucella spp.
AVPKQRD

SEQ ID NO: 14705 - protein, 7 aa, Brucella spp.
AKSRNEV

SEQ ID NO: 14706 - protein, 7 aa, Brucella spp.
DNPKESP

SEQ ID NO: 14707 - protein, 5 aa, Brucella spp.
KLKPY

SEQ ID NO: 14708 - protein, 7 aa, Brucella spp.
ALDQSPE

SEQ ID NO: 14709 - protein, 10 aa, Brucella spp.
KIKSTREKNN

SEQ ID NO: 14710 - protein, 10 aa, Brucella spp.
RKTISAYERP

SEQ ID NO: 14711 - protein, 12 aa, Brucella spp.
ETMASVPTQQAA

SEQ ID NO: 14712 - protein, 19 aa, Brucella spp.
ELREEKPRSAQKSASKPNL

SEQ ID NO: 14713 - protein, 4 aa, Brucella spp.
TTMP

SEQ ID NO: 14714 - protein, 5 aa, Brucella spp.
QIGDP

SEQ ID NO: 14715 - protein, 15 aa, Brucella spp.
DSSRFGVSLTEIIGK

SEQ ID NO: 14716 - protein, 4 aa, Brucella spp.
RSEM

SEQ ID NO: 14717 - protein, 9 aa, Brucella spp.
DLNRDDLNR

SEQ ID NO: 14718 - protein, 4 aa, Brucella spp.
TEQI

SEQ ID NO: 14719 - protein, 8 aa, Brucella spp.
LREADPKL

SEQ ID NO: 14720 - protein, 7 aa, Brucella spp.
LSARGRR

SEQ ID NO: 14721 - protein, 16 aa, Brucella spp.
ELSAEQGNITSQNIAE

SEQ ID NO: 14722 - protein, 20 aa, Brucella spp.
EEATEQKIRDALDKGNMPFS

SEQ ID NO: 14723 - protein, 4 aa, Brucella spp.
PAAT

SEQ ID NO: 14724 - protein, 6 aa, Brucella spp.
AEDATR

SEQ ID NO: 14725 - protein, 7 aa, Brucella spp.
SAFQNAP

SEQ ID NO: 14726 - protein, 11 aa, Brucella spp.
IRPQASRISPL

SEQ ID NO: 14727 - protein, 9 aa, Brucella spp.
VATDPGALP

SEQ ID NO: 14728 - protein, 18 aa, Brucella spp.
TRQEVKDELKQSEGDPLV

SEQ ID NO: 14729 - protein, 10 aa, Brucella spp.
RSLGRDRARR

SEQ ID NO: 14730 - protein, 9 aa, Brucella spp.
YKPNEDAAP

SEQ ID NO: 14731 - protein, 4 aa, Brucella spp.
FQSD

SEQ ID NO: 14732 - protein, 14 aa, Brucella spp.
RGRVGDCTKVNSAD

SEQ ID NO: 14733 - protein, 22 aa, Brucella spp.
DAPYYRNDTSAIARDLKEDADI

SEQ ID NO: 14734 - protein, 5 aa, Brucella spp.
EKHGL

SEQ ID NO: 14735 - protein, 8 aa, Brucella spp.
ARNPKGVA

SEQ ID NO: 14736 - protein, 7 aa, Brucella spp.
EDEDRTQ

SEQ ID NO: 14737 - protein, 7 aa, Brucella spp.
KDANSVA

SEQ ID NO: 14738 - protein, 9 aa, Brucella spp.
ANGKTDGEI

SEQ ID NO: 14739 - protein, 9 aa, Brucella spp.
CSNRTSAVA

SEQ ID NO: 14740 - protein, 14 aa, Brucella spp.
GKNPADDRIDPKKT

SEQ ID NO: 14741 - protein, 14 aa, Brucella spp.
SEIQAGLGASTDEI

SEQ ID NO: 14742 - protein, 7 aa, Brucella spp.
PPSKRSI

SEQ ID NO: 14743 - protein, 5 aa, Brucella spp.
APTIG

SEQ ID NO: 14744 - protein, 8 aa, Brucella spp.
EEGPRNDW

SEQ ID NO: 14745 - protein, 6 aa, Brucella spp.
TLPPSL

SEQ ID NO: 14746 - protein, 4 aa, Brucella spp.
LGGA

SEQ ID NO: 14747 - protein, 10 aa, Brucella spp.
VRNGNAEAEN

SEQ ID NO: 14748 - protein, 10 aa, Brucella spp.
KYNAAGMDGA

SEQ ID NO: 14749 - protein, 13 aa, Brucella spp.
KPSPAAGGGGGGH

SEQ ID NO: 14750 - protein, 4 aa, Brucella spp.
RDEP

SEQ ID NO: 14751 - protein, 4 aa, Brucella spp.
AGRL

SEQ ID NO: 14752 - protein, 4 aa, Brucella spp.
IRKP

SEQ ID NO: 14753 - protein, 10 aa, Brucella spp.
GAPVDTETTR

SEQ ID NO: 14754 - protein, 10 aa, Brucella spp.
AGNSDYRDTV

SEQ ID NO: 14755 - protein, 8 aa, Brucella spp.
ALGPNDPT

SEQ ID NO: 14756 - protein, 11 aa, Brucella spp.
SGGAEGARHGP

SEQ ID NO: 14757 - protein, 7 aa, Brucella spp.
GTEQAYE

SEQ ID NO: 14758 - protein, 6 aa, Brucella spp.
KYQGEP

SEQ ID NO: 14759 - protein, 6 aa, Brucella spp.
GPDGAG

SEQ ID NO: 14760 - protein, 6 aa, Brucella spp.
LSAPAI

SEQ ID NO: 14761 - protein, 6 aa, Brucella spp.
NEGPLN

SEQ ID NO: 14762 - protein, 10 aa, Brucella spp.
KSTDPETGKA

SEQ ID NO: 14763 - protein, 10 aa, Brucella spp.
EAGQKGTGRW

SEQ ID NO: 14764 - protein, 5 aa, Brucella spp.
ATGIE

SEQ ID NO: 14765 - protein, 26 aa, Brucella spp.
ARSLSSMKGEREEADKAYKSGARTLD

SEQ ID NO: 14766 - protein, 6 aa, Brucella spp.
ASREHG

SEQ ID NO: 14767 - protein, 8 aa, Brucella spp.
AFEGNESR

SEQ ID NO: 14768 - protein, 4 aa, Brucella spp.
QALG

SEQ ID NO: 14769 - protein, 12 aa, Brucella spp.
IDKEGDFHGPWG

SEQ ID NO: 14770 - protein, 15 aa, Brucella spp.
FTPAGGAETETGGDI

SEQ ID NO: 14771 - protein, 8 aa, Brucella spp.
SSDPATAV

SEQ ID NO: 14772 - protein, 7 aa, Brucella spp.
QDGDGYS

SEQ ID NO: 14773 - protein, 13 aa, Brucella spp.
LGTHGADAIEPQN

SEQ ID NO: 14774 - protein, 8 aa, Brucella spp.
SQTGSKTT

SEQ ID NO: 14775 - protein, 7 aa, Brucella spp.
KRPWTGY

SEQ ID NO: 14776 - protein, 5 aa, Brucella spp.
RHAAR

SEQ ID NO: 14777 - protein, 6 aa, Brucella spp.
KYTTGF

SEQ ID NO: 14778 - protein, 4 aa, Brucella spp.
KPLR

SEQ ID NO: 14779 - protein, 8 aa, Brucella spp.
LANPKWPE

SEQ ID NO: 14780 - protein, 9 aa, Brucella spp.
QNGKSGLND

SEQ ID NO: 14781 - protein, 7 aa, Brucella spp.
PPPTEDE

SEQ ID NO: 14782 - protein, 7 aa, Brucella spp.
TRRPEGP

SEQ ID NO: 14783 - protein, 5 aa, Brucella spp.
ENYQG

SEQ ID NO: 14784 - protein, 6 aa, Brucella spp.
ANPAPE

SEQ ID NO: 14785 - protein, 8 aa, Brucella spp.
GSSFDTAS

SEQ ID NO: 14786 - protein, 21 aa, Brucella spp.
AGATPDRISYGNTIKKERDIA

SEQ ID NO: 14787 - protein, 6 aa, Brucella spp.
RVAPGS

SEQ ID NO: 14788 - protein, 8 aa, Brucella spp.
DGEGAKWP

SEQ ID NO: 14789 - protein, 8 aa, Brucella spp.
GSQQTDLT

SEQ ID NO: 14790 - protein, 5 aa, Brucella spp.
GGFPT

SEQ ID NO: 14791 - protein, 6 aa, Brucella spp.
VPTAQA

SEQ ID NO: 14792 - protein, 5 aa, Brucella spp.
PGRGM

SEQ ID NO: 14793 - protein, 7 aa, Brucella spp.
RKADNDN

SEQ ID NO: 14794 - protein, 4 aa, Brucella spp.
LAET

SEQ ID NO: 14795 - protein, 9 aa, Brucella spp.
PHDGSETEP

SEQ ID NO: 14796 - protein, 7 aa, Brucella spp.
GPTCDSA

SEQ ID NO: 14797 - protein, 6 aa, Brucella spp.
KTPYPL

SEQ ID NO: 14798 - protein, 8 aa, Brucella spp.
TGAYTTTY

SEQ ID NO: 14799 - protein, 7 aa, Brucella spp.
APDGTVQ

SEQ ID NO: 14800 - protein, 6 aa, Brucella spp.
KGDLQL

SEQ ID NO: 14801 - protein, 12 aa, Brucella spp.
DGKDVKMARPTD

SEQ ID NO: 14802 - protein, 13 aa, Brucella spp.
SKPEKPLKLAPGH

SEQ ID NO: 14803 - protein, 5 aa, Brucella spp.
PAGCT

SEQ ID NO: 14804 - protein, 16 aa, Brucella spp.
IRPDPDEAIAQNQATL

SEQ ID NO: 14805 - protein, 8 aa, Brucella spp.
NDPTGTDM

SEQ ID NO: 14806 - protein, 17 aa, Brucella spp.
KNKTPVELLAFAETLEV

SEQ ID NO: 14807 - protein, 18 aa, Brucella spp.
KTPVELLAFAETLEVENA

SEQ ID NO: 14808 - protein, 23 aa, Brucella spp.
MRKQELMFAILKKLAAQDVEIIG

SEQ ID NO: 14809 - protein, 17 aa, Brucella spp.
LQDGFGFLRSADANYLP

SEQ ID NO: 14810 - protein, 24 aa, Brucella spp.
GPKEGERYFALLKVNTINFEDPEK

SEQ ID NO: 14811 - protein, 25 aa, Brucella spp.
TANHPECYLIVLLIDERPEEVTDMQ

SEQ ID NO: 14812 - protein, 20 aa, Brucella spp.
NALQRPKRFFGAARNIEEGG

SEQ ID NO: 14813 - protein, 18 aa, Brucella spp.
VLDRKVADKRIFPAMDIL

SEQ ID NO: 14814 - protein, 23 aa, Brucella spp.
RKVADKRIFPAMDILKSGTRKED

SEQ ID NO: 14815 - protein, 26 aa, Brucella spp.
LVPRADLQKIFVLRRILAPMGTTDAI

SEQ ID NO: 14816 - protein, 21 aa, Brucella spp.
IPEPRHAALLTFRSRNGDAID

SEQ ID NO: 14817 - protein, 23 aa, Brucella spp.
IDRGLTLFFPAPHSFTGEDCAEF

SEQ ID NO: 14818 - protein, 18 aa, Brucella spp.
SDVPGSVSMQVWQQLSAL

SEQ ID NO: 14819 - protein, 25 aa, Brucella spp.
LEVKLDLGGIPVYVTDTAGLRETDS

SEQ ID NO: 14820 - protein, 17 aa, Brucella spp.
RMAEADLVLSLEDMSGP

SEQ ID NO: 14821 - protein, 18 aa, Brucella spp.
ASGLWKYHISTMTGSGLE

SEQ ID NO: 14822 - protein, 17 aa, Brucella spp.
LVTHRFDTIGVMSCNPA

SEQ ID NO: 14823 - protein, 17 aa, Brucella spp.
REIDALDGLMGRVADRA

SEQ ID NO: 14824 - protein, 27 aa, Brucella spp.
PALGLSERLLSFGFTLGRLKTGTPPRL

SEQ ID NO: 14825 - protein, 19 aa, Brucella spp.
DEEPVPFSLMTDRITTPQI

SEQ ID NO: 14826 - protein, 21 aa, Brucella spp.
LPEDVQLEILKTIPGLEKAVL

SEQ ID NO: 14827 - protein, 25 aa, Brucella spp.
IPGLEKAVLLQPGYAIEYDFIDPRE

SEQ ID NO: 14828 - protein, 18 aa, Brucella spp.
TRKVCGLFLAGQINGTTG

SEQ ID NO: 14829 - protein, 18 aa, Brucella spp.
RSAYDLLSYPDINLDRLI

SEQ ID NO: 14830 - protein, 23 aa, Brucella spp.
YPDINLDRLIAIWPELASIDPVT

SEQ ID NO: 14831 - protein, 19 aa, Brucella spp.
IAIWPELASIDPVTREALE

SEQ ID NO: 14832 - protein, 26 aa, Brucella spp.
REERLLIPSGLDFDAISGLSNELKQK

SEQ ID NO: 14833 - protein, 23 aa, Brucella spp.
AVALLIAQIRKFGGRQKLAAETL

SEQ ID NO: 14834 - protein, 19 aa, Brucella spp.
LRFDSGVSERFTYVLVDCP

SEQ ID NO: 14835 - protein, 19 aa, Brucella spp.
SGVSERFTYVLVDCPPSLN

SEQ ID NO: 14836 - protein, 18 aa, Brucella spp.
PPSLNLLTLNAMAAADSV

SEQ ID NO: 14837 - protein, 23 aa, Brucella spp.
LVPLQCEFFALEGLGQLLQTVDQ

SEQ ID NO: 14838 - protein, 20 aa, Brucella spp.
ELSIQGIVLTMFDSRNNLAT

SEQ ID NO: 14839 - protein, 22 aa, Brucella spp.
STSSFPVVLLYGPDKGLVNERA

SEQ ID NO: 14840 - protein, 19 aa, Brucella spp.
AASKLPLDDPFAVIRMEAD

SEQ ID NO: 14841 - protein, 18 aa, Brucella spp.
GTISMFGGQRLIWIKNAG

SEQ ID NO: 14842 - protein, 25 aa, Brucella spp.
DDILAEWKMQITLDARQLLRASLGG

SEQ ID NO: 14843 - protein, 21 aa, Brucella spp.
DLPRFEIAFDRVVKSGTAPFL

SEQ ID NO: 14844 - protein, 18 aa, Brucella spp.
GTAPFLLLTAAMRQFQQV

SEQ ID NO: 14845 - protein, 21 aa, Brucella spp.
AALSVPIIRQCLLAISVESLR

SEQ ID NO: 14846 - protein, 25 aa, Brucella spp.
HHFARQLASPFPLLAAIGAKTSRIE

SEQ ID NO: 14847 - protein, 21 aa, Brucella spp.
EQVIDGWRYFGYKPEEGKTDA

SEQ ID NO: 14848 - protein, 17 aa, Brucella spp.
VSVSRSIFALVNDRDRA

SEQ ID NO: 14849 - protein, 21 aa, Brucella spp.
SGLGCPDMMLKAIGERFDETG

SEQ ID NO: 14850 - protein, 20 aa, Brucella spp.
SSAEPPLIWQMITNNEIPAY

SEQ ID NO: 14851 - protein, 25 aa, Brucella spp.
IPAYNIPSGILFDMHREAAARRPGV

SEQ ID NO: 14852 - protein, 26 aa, Brucella spp.
SFEGEDWLYFPAIAPQVAIIRATTAD

SEQ ID NO: 14853 - protein, 19 aa, Brucella spp.
HDVRVPGVLVDYIVVDPDQ

SEQ ID NO: 14854 - protein, 22 aa, Brucella spp.
ISGEIFRPLDTFRLPEFNIQKA

SEQ ID NO: 14855 - protein, 18 aa, Brucella spp.
FRLPEFNIQKAIARRVAQ

SEQ ID NO: 14856 - protein, 24 aa, Brucella spp.
ILLEEGLHGAVTWVIEQGAVGGVP

SEQ ID NO: 14857 - protein, 18 aa, Brucella spp.
PSPYQFTYFQGAGFDASL

SEQ ID NO: 14858 - protein, 17 aa, Brucella spp.
AEFPLIVSDQLKLMDEA

SEQ ID NO: 14859 - protein, 17 aa, Brucella spp.
REEPIGLTLPQKPARKL

SEQ ID NO: 14860 - protein, 24 aa, Brucella spp.
NRDPRAIFQRGFFRPKELWYETSG

SEQ ID NO: 14861 - protein, 20 aa, Brucella spp.
GGNSKFYGAVLIRYRREDFE

SEQ ID NO: 14862 - protein, 17 aa, Brucella spp.
FYGAVLIRYRREDFEEL

SEQ ID NO: 14863 - protein, 27 aa, Brucella spp.
ELAHLEGVSPAWPFSYDELEPWYCKAE

SEQ ID NO: 14864 - protein, 24 aa, Brucella spp.
GLHPASLPLGVDIERWLAKARTPW

SEQ ID NO: 14865 - protein, 26 aa, Brucella spp.
NMRHVPEWLLNRIAGHTIDFYAMSED

SEQ ID NO: 14866 - protein, 18 aa, Brucella spp.
DRIILHWVRSNWKEHLML

SEQ ID NO: 14867 - protein, 27 aa, Brucella spp.
SALRAVGFPVVLSRAFDRRTPSHQCGT

SEQ ID NO: 14868 - protein, 23 aa, Brucella spp.
SGDKVFFSQTFDIGVANTGATDI

SEQ ID NO: 14869 - protein, 21 aa, Brucella spp.
INLDKVCFIALGDKGKTFNAD

SEQ ID NO: 14870 - protein, 23 aa, Brucella spp.
KSGESVKGFAAFAGSDKSIYDVR

SEQ ID NO: 14871 - protein, 23 aa, Brucella spp.
ETRNFRGSVALLFQPAEEGGAGG

SEQ ID NO: 14872 - protein, 20 aa, Brucella spp.
DGVMDRFGISEVYGVHNMPG

SEQ ID NO: 14873 - protein, 25 aa, Brucella spp.
SYMLEARPGAYIFLGNGDTPGLHHP

SEQ ID NO: 14874 - protein, 19 aa, Brucella spp.
CLEYIDRLFTEFTPLAGDR

SEQ ID NO: 14875 - protein, 18 aa, Brucella spp.
ANDEALQAGFGRFNGTPV

SEQ ID NO: 14876 - protein, 25 aa, Brucella spp.
VRIMEMADRFQLPLITFVDTAGAYP

SEQ ID NO: 14877 - protein, 22 aa, Brucella spp.
ECLKLRVPVISIIIGEGGSGGA

SEQ ID NO: 14878 - protein, 23 aa, Brucella spp.
VISPEGAASILWHDSTRAKDAAS

SEQ ID NO: 14879 - protein, 21 aa, Brucella spp.
AQDLFDLKIIDGIIPEPLGGA

SEQ ID NO: 14880 - protein, 18 aa, Brucella spp.
LKIIDGIIPEPLGGAHRG

SEQ ID NO: 14881 - protein, 26 aa, Brucella spp.
QARRLSALRQFFRFLYSEGFRQDDPT

SEQ ID NO: 14882 - protein, 21 aa, Brucella spp.
PGERIKALRLHALLETLYATG

SEQ ID NO: 14883 - protein, 25 aa, Brucella spp.
LHALLETLYATGLRVSELVGLPVTV

SEQ ID NO: 14884 - protein, 18 aa, Brucella spp.
SELVGLPVTVARTDHRFL

SEQ ID NO: 14885 - protein, 20 aa, Brucella spp.
GSDDNPWLFPAFSESGHLAR

SEQ ID NO: 14886 - protein, 18 aa, Brucella spp.
PWLFPAFSESGHLARQVF

SEQ ID NO: 14887 - protein, 17 aa, Brucella spp.
VVVLVGLMGAGKSTIGR

SEQ ID NO: 14888 - protein, 23 aa, Brucella spp.
AAIAEAGISIWINADLDVLMERV

SEQ ID NO: 14889 - protein, 23 aa, Brucella spp.
MDERYPVYALAELHLMTRDEKKE

SEQ ID NO: 14890 - protein, 29 aa, Brucella spp.
VAKYGLIDRPDFFAWLEANWQEVFSGGAA

SEQ ID NO: 14891 - protein, 32 aa, Brucella spp.
HGEGVAIGMALAYRFSARMNLAGIEAAERVEA

SEQ ID NO: 14892 - protein, 19 aa, Brucella spp.
TRGTLTFILTHGIGQSFIA

SEQ ID NO: 14893 - protein, 18 aa, Brucella spp.
KLTAAFAPEKLEVINESR

SEQ ID NO: 14894 - protein, 25 aa, Brucella spp.
GETHFRIRIVAEAFTGMSRVQRHRA

SEQ ID NO: 14895 - protein, 18 aa, Brucella spp.
EELESGVHALALEPSAPG

SEQ ID NO: 14896 - protein, 24 aa, Brucella spp.
PRTLELKALATLGLDANSTGDKIK

SEQ ID NO: 14897 - protein, 18 aa, Brucella spp.
KIKARYKELVKLHHPDAN

SEQ ID NO: 14898 - protein, 17 aa, Brucella spp.
ARYKELVKLHHPDANGG

SEQ ID NO: 14899 - protein, 18 aa, Brucella spp.
ATHIPVRMKQAAVPRPRG

SEQ ID NO: 14900 - protein, 23 aa, Brucella spp.
SYVPELDPDYLFDRQTTLAILAG

SEQ ID NO: 14901 - protein, 22 aa, Brucella spp.
DRQTTLAILAGFAYNRRVMVSG

SEQ ID NO: 14902 - protein, 30 aa, Brucella spp.
QVTEFKDGILPWAYQHNVALVFDEYDAGRP

SEQ ID NO: 14903 - protein, 22 aa, Brucella spp.
RVIRPHPAFRLFATANTVGLGD

SEQ ID NO: 14904 - protein, 22 aa, Brucella spp.
QMDRWSIVTTLNYLPHDNEVNI

SEQ ID NO: 14905 - protein, 26 aa, Brucella spp.
AAIFNDVGFAFRLTFLNKCDELERAT

SEQ ID NO: 14906 - protein, 19 aa, Brucella spp.
RPTAHDIAVTRGLGDSMAL

SEQ ID NO: 14907 - protein, 17 aa, Brucella spp.
GKQARAIFDAVEQARVE

SEQ ID NO: 14908 - protein, 24 aa, Brucella spp.
DAPLEEAVSLLLREKLTGRPAPAE

SEQ ID NO: 14909 - protein, 26 aa, Brucella spp.
PAPAEAGQVLELWRDWIEQKASADIA

SEQ ID NO: 14910 - protein, 29 aa, Brucella spp.
LERCGVKVEILGFTTKAWKGGQSREAWLG

SEQ ID NO: 14911 - protein, 17 aa, Brucella spp.
GQSREAWLGRGKPANPG

SEQ ID NO: 14912 - protein, 17 aa, Brucella spp.
DAPWRRARRNLGLMMRE

SEQ ID NO: 14913 - protein, 23 aa, Brucella spp.
KENIDGEALIWAHQRLLGRPEQR

SEQ ID NO: 14914 - protein, 26 aa, Brucella spp.
IETRSPVELIAIGIGHDVTRYYQRAV

SEQ ID NO: 14915 - protein, 25 aa, Brucella spp.
RGSGGGGVAFVLNGQIFTVAASARI

SEQ ID NO: 14916 - protein, 23 aa, Brucella spp.
TDAEMGGGGGLGIILNTGTLVVD

SEQ ID NO: 14917 - protein, 19 aa, Brucella spp.
PEGSPGGGVYMRSSTTVNL

SEQ ID NO: 14918 - protein, 24 aa, Brucella spp.
ISTPKMKSPPALILDGSDSVINNQ

SEQ ID NO: 14919 - protein, 25 aa, Brucella spp.
QGTIARLFPSIPELFSVDANVVPAI

SEQ ID NO: 14920 - protein, 28 aa, Brucella spp.
LFSVDANVVPAIYVRGDRNYIINSHIIL

SEQ ID NO: 14921 - protein, 23 aa, Brucella spp.
DNTLELWGGQSMRGVVRVTGGGT

SEQ ID NO: 14922 - protein, 21 aa, Brucella spp.
NAGTFNFGLLDQIDPGSENRQ

SEQ ID NO: 14923 - protein, 22 aa, Brucella spp.
RQQMGYMGFVDFVKNGTSTWSG

SEQ ID NO: 14924 - protein, 18 aa, Brucella spp.
LDQGTVIFTGDNTYTGTS

SEQ ID NO: 14925 - protein, 22 aa, Brucella spp.
SDAAVNGQLIFNRSDSFTYDKV

SEQ ID NO: 14926 - protein, 30 aa, Brucella spp.
QDMGDFGPGLYRLFDFGGTRSGNLTLGSVP

SEQ ID NO: 14927 - protein, 20 aa, Brucella spp.
QYNLFFGGQPGFNIWDGGNS

SEQ ID NO: 14928 - protein, 18 aa, Brucella spp.
FGGQPGFNIWDGGNSADH

SEQ ID NO: 14929 - protein, 17 aa, Brucella spp.
WVNGALAQFGVKAGTVT

SEQ ID NO: 14930 - protein, 17 aa, Brucella spp.
NGALAQFGVKAGTVTIS

SEQ ID NO: 14931 - protein, 18 aa, Brucella spp.
TIESEIKGNQGLKKVDFG

SEQ ID NO: 14932 - protein, 19 aa, Brucella spp.
IKGNQGLKKVDFGTLVLTG

SEQ ID NO: 14933 - protein, 17 aa, Brucella spp.
LAFNHSSAVTFGSSISG

SEQ ID NO: 14934 - protein, 17 aa, Brucella spp.
HSSAVTFGSSISGGGKV

SEQ ID NO: 14935 - protein, 20 aa, Brucella spp.
MASLDNAGLVNFGGTGCATL

SEQ ID NO: 14936 - protein, 20 aa, Brucella spp.
LNRLPTLQQRVGNSYWNGPS

SEQ ID NO: 14937 - protein, 17 aa, Brucella spp.
NSYWNGPSYPAIEQGGA

SEQ ID NO: 14938 - protein, 18 aa, Brucella spp.
GPSYPAIEQGGAPAGADP

SEQ ID NO: 14939 - protein, 19 aa, Brucella spp.
DNGIWARIGGDYSKLQSSR

SEQ ID NO: 14940 - protein, 17 aa, Brucella spp.
KFYEADTGKLIGGINAL

SEQ ID NO: 14941 - protein, 21 aa, Brucella spp.
YEADTGKLIGGINALYGSAIS

SEQ ID NO: 14942 - protein, 26 aa, Brucella spp.
TTSAWGLGGTLTWYGESGFYVDGQAQ

SEQ ID NO: 14943 - protein, 17 aa, Brucella spp.
WYGESGFYVDGQAQINW

SEQ ID NO: 14944 - protein, 32 aa, Brucella spp.
GYAVSIETGQRFNIGERWSVTPQAQLMWSKLS

SEQ ID NO: 14945 - protein, 22 aa, Brucella spp.
WSVTPQAQLMWSKLSMDTFNNI

SEQ ID NO: 14946 - protein, 24 aa, Brucella spp.
SLIGRAGVALDYRNAWQDDAGQIV

SEQ ID NO: 14947 - protein, 21 aa, Brucella spp.
TFSVKQDVTWGGVGLGGSYAW

SEQ ID NO: 14948 - protein, 25 aa, Brucella spp.
TWGGVGLGGSYAWADNKYLIYGEGA

SEQ ID NO: 14949 - protein, 25 aa, Brucella spp.
AWADNKYLIYGEGAINTSLNNFADS

SEQ ID NO: 14950 - protein, 23 aa, Brucella spp.
APKPGTDRFTFIFASNPNGNVKV

SEQ ID NO: 14951 - protein, 27 aa, Brucella spp.
ASATSFSILPSVSFPVITRNPSPALQV

SEQ ID NO: 14952 - protein, 23 aa, Brucella spp.
QATNKLGVATIFIATNQNPGYLR

SEQ ID NO: 14953 - protein, 17 aa, Brucella spp.
TNQNPGYLRIFCETNTI

SEQ ID NO: 14954 - protein, 30 aa, Brucella spp.
CETNTIRGASAFVYIFDTAFGTELEAPDTD

SEQ ID NO: 14955 - protein, 22 aa, Brucella spp.
SPNEFIALFLNNKFQNQIAGTN

SEQ ID NO: 14956 - protein, 17 aa, Brucella spp.
LFLNNKFQNQIAGTNLN

SEQ ID NO: 14957 - protein, 17 aa, Brucella spp.
NQILGPLVDPNGGVINL

SEQ ID NO: 14958 - protein, 25 aa, Brucella spp.
DPTDSAFNIIIPFDDISGYGTPKDP

SEQ ID NO: 14959 - protein, 21 aa, Brucella spp.
RSNLYKMYYEITPASATTPIA

SEQ ID NO: 14960 - protein, 19 aa, Brucella spp.
TDQTAFLLLNDVVIDSQPI

SEQ ID NO: 14961 - protein, 20 aa, Brucella spp.
GKPPQFTIPVANNFSAGNEY

SEQ ID NO: 14962 - protein, 22 aa, Brucella spp.
QNIGISQKLTFDVREDSLEKDL

SEQ ID NO: 14963 - protein, 18 aa, Brucella spp.
TDDYPYLMPANIAVIQGP

SEQ ID NO: 14964 - protein, 22 aa, Brucella spp.
FDENGVAPLVLIRIDKLHVDAV

SEQ ID NO: 14965 - protein, 18 aa, Brucella spp.
IFSRPVSFDDYVPVTDPN

SEQ ID NO: 14966 - protein, 21 aa, Brucella spp.
DGNTICIISIVFNKRYIDTSS

SEQ ID NO: 14967 - protein, 17 aa, Brucella spp.
GTYKVSFFPSKSALAYF

SEQ ID NO: 14968 - protein, 22 aa, Brucella spp.
YKVSFFPSKSALAYFSKDILFK

SEQ ID NO: 14969 - protein, 19 aa, Brucella spp.
SFHIPPRSFQFLTGPSGAG

SEQ ID NO: 14970 - protein, 26 aa, Brucella spp.
HKEIPLLRRRIGIVFQDFRLLDHMTT

SEQ ID NO: 14971 - protein, 24 aa, Brucella spp.
YRHEVEELLHWVGLGDRMRVLPPV

SEQ ID NO: 14972 - protein, 19 aa, Brucella spp.
DPPLAKRLLRLFTELNRSG

SEQ ID NO: 14973 - protein, 25 aa, Brucella spp.
RPLIPGCVINVRPIGVLVMEDNSGK

SEQ ID NO: 14974 - protein, 20 aa, Brucella spp.
PEITLKQIAHFFEHYKDLEP

SEQ ID NO: 14975 - protein, 22 aa, Brucella spp.
YKDLEPGKWVKIGDWGDEDYAR

SEQ ID NO: 14976 - protein, 21 aa, Brucella spp.
VFGYGSLMWRPGFAHVETVRA

SEQ ID NO: 14977 - protein, 21 aa, Brucella spp.
GTPDHPGLVLGLDTGGSCLGI

SEQ ID NO: 14978 - protein, 25 aa, Brucella spp.
DTGGSCLGIAFRVPGDMTDEVMTYL

SEQ ID NO: 14979 - protein, 23 aa, Brucella spp.
AERAVRMALAGLWSHVPGERLVG

SEQ ID NO: 14980 - protein, 19 aa, Brucella spp.
GERLVGLGYSLPYLDRFGA

SEQ ID NO: 14981 - protein, 20 aa, Brucella spp.
GLGYSLPYLDRFGADTERTF

SEQ ID NO: 14982 - protein, 27 aa, Brucella spp.
LESMGRRLWPLFAGVLIIEAQKRLYQG

SEQ ID NO: 14983 - protein, 21 aa, Brucella spp.
LKGSFIFAADLIRAMHDAGVE

SEQ ID NO: 14984 - protein, 20 aa, Brucella spp.
AFECPDYFVVGYGMDVGHAF

SEQ ID NO: 14985 - protein, 18 aa, Brucella spp.
LPEIAKAVGTPFYVYSRA

SEQ ID NO: 14986 - protein, 19 aa, Brucella spp.
IAKAVGTPFYVYSRATIER

SEQ ID NO: 14987 - protein, 22 aa, Brucella spp.
REMDFALEAGIYCFNVESEPEL

SEQ ID NO: 14988 - protein, 17 aa, Brucella spp.
LEILSARAVAAGKVAPV

SEQ ID NO: 14989 - protein, 21 aa, Brucella spp.
RHVDVGGGLGIPYRTPNTPPP

SEQ ID NO: 14990 - protein, 18 aa, Brucella spp.
KHIKPLGLKTVFEPGRLI

SEQ ID NO: 14991 - protein, 20 aa, Brucella spp.
PLGLKTVFEPGRLIVGNAGL

SEQ ID NO: 14992 - protein, 18 aa, Brucella spp.
AIMEEINASIGFDRKLYA

SEQ ID NO: 14993 - protein, 18 aa, Brucella spp.
INASIGFDRKLYAQDIQG

SEQ ID NO: 14994 - protein, 17 aa, Brucella spp.
MNIEARLAELIGPAAGR

SEQ ID NO: 14995 - protein, 21 aa, Brucella spp.
IEARLAELIGPAAGRLHTARS

SEQ ID NO: 14996 - protein, 17 aa, Brucella spp.
NDQVAVDFRLWVKQELE

SEQ ID NO: 14997 - protein, 18 aa, Brucella spp.
AEEHAATVMPGFTHLQTA

SEQ ID NO: 14998 - protein, 19 aa, Brucella spp.
GHHCMAYVEMFGRDLSRVR

SEQ ID NO: 14999 - protein, 18 aa, Brucella spp.
PIDRHMTAKALGFREPTR

SEQ ID NO: 15000 - protein, 27 aa, Brucella spp.
DRDYALEFLSLAAICAGHLSRLAEEIV

SEQ ID NO: 15001 - protein, 30 aa, Brucella spp.
GHLSRLAEEIVIWSTPQFNFVRLSDAFSTG

SEQ ID NO: 15002 - protein, 21 aa, Brucella spp.
LELAIAAMAGMVRDLTVNVAA

SEQ ID NO: 15003 - protein, 20 aa, Brucella spp.
ANLQPLRSFILPGGSPASAA

SEQ ID NO: 15004 - protein, 20 aa, Brucella spp.
EKVSPEALQYINRLSDFLFV

SEQ ID NO: 15005 - protein, 21 aa, Brucella spp.
YINRLSDFLFVAGRAVNDNGA

SEQ ID NO: 15006 - protein, 20 aa, Brucella spp.
DNGASDILWVPGAQSLSERG

SEQ ID NO: 15007 - protein, 17 aa, Brucella spp.
RHEWKPMSVEAIWHEVT

SEQ ID NO: 15008 - protein, 20 aa, Brucella spp.
HELAALKHYIDDTFDHRHLN

SEQ ID NO: 15009 - protein, 36 aa, Brucella spp.
QTTAERLAKHFFDWCHARWPEISAVRSAKHRRPGRN

SEQ ID NO: 15010 - protein, 24 aa, Brucella spp.
PFDEIAVEEAIRLKEAGKVTEIVA

SEQ ID NO: 15011 - protein, 23 aa, Brucella spp.
ETLRTALAMGADRAILVKTDETV

SEQ ID NO: 15012 - protein, 23 aa, Brucella spp.
VVEAEKPDLVFLGKQAIDDDSNQ

SEQ ID NO: 15013 - protein, 24 aa, Brucella spp.
QTGQMLSALLNWSQATFASKVELG

SEQ ID NO: 15014 - protein, 19 aa, Brucella spp.
DVKLPAIVTVDLRLNQPRY

SEQ ID NO: 15015 - protein, 17 aa, Brucella spp.
AKLKGVRKVLLAESDAL

SEQ ID NO: 15016 - protein, 17 aa, Brucella spp.
ILPRVAALLDVMQLSEI

SEQ ID NO: 15017 - protein, 17 aa, Brucella spp.
VAALLDVMQLSEIMEVV

SEQ ID NO: 15018 - protein, 20 aa, Brucella spp.
SEIMEVVSADTFKRPIYAGN

SEQ ID NO: 15019 - protein, 20 aa, Brucella spp.
VVSADTFKRPIYAGNAIQTV

SEQ ID NO: 15020 - protein, 21 aa, Brucella spp.
FKRPIYAGNAIQTVQSTDAKK

SEQ ID NO: 15021 - protein, 23 aa, Brucella spp.
GDRPELTSAKIIISGGRALGSAE

SEQ ID NO: 15022 - protein, 18 aa, Brucella spp.
FQEVILPVADKLGAAVGA

SEQ ID NO: 15023 - protein, 25 aa, Brucella spp.
KVVAPDLYIAVGISGAIQHLAGMKD

SEQ ID NO: 15024 - protein, 19 aa, Brucella spp.
AGMKDSRIIVAINKDEEAP

SEQ ID NO: 15025 - protein, 26 aa, Brucella spp.
NGVKANLLVKLEFFNPLASVKDRIGL

SEQ ID NO: 15026 - protein, 17 aa, Brucella spp.
EGIPVGISSGAALAAAI

SEQ ID NO: 15027 - protein, 21 aa, Brucella spp.
GAVKPPVFLTSTFVFKTAEDG

SEQ ID NO: 15028 - protein, 21 aa, Brucella spp.
EPPAGVGAGLVYSRFNHPNSE

SEQ ID NO: 15029 - protein, 24 aa, Brucella spp.
GGTETLLAKTFFNFGVEAVAFADG

SEQ ID NO: 15030 - protein, 18 aa, Brucella spp.
DPHSCWMLGRSLETLGLR

SEQ ID NO: 15031 - protein, 20 aa, Brucella spp.
KRQCTGAGSTFSFDIKGGQA

SEQ ID NO: 15032 - protein, 24 aa, Brucella spp.
FDIKGGQAAAFRFLNALQILKLAV

SEQ ID NO: 15033 - protein, 25 aa, Brucella spp.
GERDIPMDAYFGIQTLRAVENFSLS

SEQ ID NO: 15034 - protein, 17 aa, Brucella spp.
IQTLRAVENFSLSDVAL

SEQ ID NO: 15035 - protein, 22 aa, Brucella spp.
LNHIPALVRALAMVKKAAATAN

SEQ ID NO: 15036 - protein, 19 aa, Brucella spp.
RQLPEPKYAAIVAACDNII

SEQ ID NO: 15037 - protein, 21 aa, Brucella spp.
VYPTAVRLALLLSQNQVQTAL

SEQ ID NO: 15038 - protein, 24 aa, Brucella spp.
AKGREFATVIKIGRTQLQDAVPIT

SEQ ID NO: 15039 - protein, 19 aa, Brucella spp.
RLEEVAALFREVNLDGTAI

SEQ ID NO: 15040 - protein, 24 aa, Brucella spp.
EASWDTGAFVTFSGILRRIAVKLS

SEQ ID NO: 15041 - protein, 27 aa, Brucella spp.
LQLNAFEPLIVYNILSSMRLLGRAMTN

SEQ ID NO: 15042 - protein, 29 aa, Brucella spp.
KRVLGMRPFDVQLIGGMVLHERGIAEMRT

SEQ ID NO: 15043 - protein, 25 aa, Brucella spp.
DAETMGRLYNFLGLTVGVIKHGLDD

SEQ ID NO: 15044 - protein, 20 aa, Brucella spp.
YGTNNELGFDYLRDNMKYER

SEQ ID NO: 15045 - protein, 17 aa, Brucella spp.
RNDEIVIIDEFTGRMMP

SEQ ID NO: 15046 - protein, 17 aa, Brucella spp.
DEIVIIDEFTGRMMPGR

SEQ ID NO: 15047 - protein, 18 aa, Brucella spp.
QTLASITFQNYFRMYNKL

SEQ ID NO: 15048 - protein, 18 aa, Brucella spp.
TFQNYFRMYNKLSGMTGT

SEQ ID NO: 15049 - protein, 24 aa, Brucella spp.
ATEAEEFGNIYGLEVLEIPTNLPV

SEQ ID NO: 15050 - protein, 22 aa, Brucella spp.
LRREGIKGFQVLNARYHEQEAY

SEQ ID NO: 15051 - protein, 20 aa, Brucella spp.
KEKALAAGGLYVLATERHES

SEQ ID NO: 15052 - protein, 24 aa, Brucella spp.
QGDPGRSKFFLSLQDDLMRIFGSD

SEQ ID NO: 15053 - protein, 19 aa, Brucella spp.
DEAIVHPWINKALEKAQKK

SEQ ID NO: 15054 - protein, 22 aa, Brucella spp.
PKDAYAEKWDIAGLKQDIASKL

SEQ ID NO: 15055 - protein, 25 aa, Brucella spp.
NLDHLRSVVGFRGYAQRDPLNEYKT

SEQ ID NO: 15056 - protein, 24 aa, Brucella spp.
YKTEAFELFQTMLANLREVVISQL

SEQ ID NO: 15057 - protein, 24 aa, Brucella spp.
ANLREVVISQLMRVEIVREAPPEP

SEQ ID NO: 15058 - protein, 23 aa, Brucella spp.
YKGRTDLMLMVFDRPAEAAGVFT

SEQ ID NO: 15059 - protein, 23 aa, Brucella spp.
VFDRPAEAAGVFTRSLCPSAPVD

SEQ ID NO: 15060 - protein, 25 aa, Brucella spp.
TRSLCPSAPVDFCRRNLVHGKARAV

SEQ ID NO: 15061 - protein, 23 aa, Brucella spp.
KAIGCATTDIFLASTGVIGEPLD

SEQ ID NO: 15062 - protein, 25 aa, Brucella spp.
GMIAPDMATMLSFVVTDAPIKADAL

SEQ ID NO: 15063 - protein, 19 aa, Brucella spp.
RVLKSLALQVVRDGEGARK

SEQ ID NO: 15064 - protein, 17 aa, Brucella spp.
DANWGRVVMAVGKAGEP

SEQ ID NO: 15065 - protein, 23 aa, Brucella spp.
PADRDRLAIWFGDIRVAHQGERD

SEQ ID NO: 15066 - protein, 17 aa, Brucella spp.
KATVWTCDLTKEYVAIN

SEQ ID NO: 15067 - protein, 29 aa, Brucella spp.
VPAEVAPEPKLSWFERLRRGLARSSSSLS

SEQ ID NO: 15068 - protein, 20 aa, Brucella spp.
GGLKVMLAAGDTFRAAAIEQ

SEQ ID NO: 15069 - protein, 23 aa, Brucella spp.
FRAAAIEQLHIWGERTGSPVVSS

SEQ ID NO: 15070 - protein, 17 aa, Brucella spp.
DELAKIVRVLGKHDPEA

SEQ ID NO: 15071 - protein, 22 aa, Brucella spp.
IFKNVAGVNGLVMTKLDGTARG

SEQ ID NO: 15072 - protein, 25 aa, Brucella spp.
AISARHKLPIYFIGVGEGIDDLEPF

SEQ ID NO: 15073 - protein, 22 aa, Brucella spp.
EGIDDLEPFAAKDFARAIAGVA

SEQ ID NO: 15074 - protein, 25 aa, Brucella spp.
LKSNSYRMLPDFGVNQFEKVRVNDI

SEQ ID NO: 15075 - protein, 20 aa, Brucella spp.
CDHRCTFCIIPYGRGNSRSV

SEQ ID NO: 15076 - protein, 17 aa, Brucella spp.
PSNLRLGKLVKTVLAQV

SEQ ID NO: 15077 - protein, 32 aa, Brucella spp.
QTARALRPDIVFGADIIAGFPTETEEMFQNSL

SEQ ID NO: 15078 - protein, 18 aa, Brucella spp.
TETEEMFQNSLKIVEECG

SEQ ID NO: 15079 - protein, 25 aa, Brucella spp.
KIVEECGLTHLHVFPYSPREGTPAA

SEQ ID NO: 15080 - protein, 18 aa, Brucella spp.
RHAFTFETRAGILTATEH

SEQ ID NO: 15081 - protein, 19 aa, Brucella spp.
NPHAVFWVDKDVWSYELDK

SEQ ID NO: 15082 - protein, 26 aa, Brucella spp.
KDVWSYELDKFGPLLENHPIFPERAN

SEQ ID NO: 15083 - protein, 20 aa, Brucella spp.
HPIFPERANISIAHVTSSDT

SEQ ID NO: 15084 - protein, 24 aa, Brucella spp.
TVNVPGGPLLIEWRDDDHVMMTGP

SEQ ID NO: 15085 - protein, 26 aa, Brucella spp.
MMTGPAEWEFSGTFDPATGEWSRDTQ

SEQ ID NO: 15086 - protein, 21 aa, Brucella spp.
ANIGETVAFLCQFQNYQVVSS

SEQ ID NO: 15087 - protein, 25 aa, Brucella spp.
ADIERELYLSILIDRSVGRPAFVVS

SEQ ID NO: 15088 - protein, 25 aa, Brucella spp.
AREDGLKLFPILYKAFTEKDMSLLE

SEQ ID NO: 15089 - protein, 20 aa, Brucella spp.
LEINPLIVMTNGRVRVLDAK

SEQ ID NO: 15090 - protein, 23 aa, Brucella spp.
PAVEGILVNIFGGIMKCDVIAEG

SEQ ID NO: 15091 - protein, 24 aa, Brucella spp.
AVKEVGLKVPLVVRLEGTNVELGK

SEQ ID NO: 15092 - protein, 18 aa, Brucella spp.
SKGEKLPIFATVAEGKER

SEQ ID NO: 15093 - protein, 27 aa, Brucella spp.
IIEAIEAEIGFIVCITEGIPVMDIVRV

SEQ ID NO: 15094 - protein, 25 aa, Brucella spp.
VCITEGIPVMDIVRVKERLERSKSR

SEQ ID NO: 15095 - protein, 26 aa, Brucella spp.
TPEECKIGIMPGNIFKKGSVGVVSRS

SEQ ID NO: 15096 - protein, 17 aa, Brucella spp.
TEFIDVLEMFLADDETK

SEQ ID NO: 15097 - protein, 23 aa, Brucella spp.
DRANDVFALTSFLYGGNADYIEE

SEQ ID NO: 15098 - protein, 22 aa, Brucella spp.
DSVRAIMMIRAYRMRGHLHANL

SEQ ID NO: 15099 - protein, 23 aa, Brucella spp.
KRTYCGAIGVEFMHISDPAEKAW

SEQ ID NO: 15100 - protein, 17 aa, Brucella spp.
IEAEGFEQFIDVKYKGT

SEQ ID NO: 15101 - protein, 25 aa, Brucella spp.
VPLSERAKVLPLLLHGDAAFAGQGV

SEQ ID NO: 15102 - protein, 18 aa, Brucella spp.
CLGLSGLKGHRVAGTLHF

SEQ ID NO: 15103 - protein, 18 aa, Brucella spp.
AVVFAAKVATEFRMTFHK

SEQ ID NO: 15104 - protein, 27 aa, Brucella spp.
MTFHKPVVIDMFCYRRFGHNEGDEPSF

SEQ ID NO: 15105 - protein, 24 aa, Brucella spp.
EGDEPSFTQPLMYKAIRAHKTTVQ

SEQ ID NO: 15106 - protein, 17 aa, Brucella spp.
KMMETGEGIDWATAESL

SEQ ID NO: 15107 - protein, 29 aa, Brucella spp.
METGEGIDWATAESLAFGSLAVEAHPIRL

SEQ ID NO: 15108 - protein, 23 aa, Brucella spp.
YSLSDPRALVLWEAQFGDFANGA

SEQ ID NO: 15109 - protein, 24 aa, Brucella spp.
RKWLRMSGLVCLLPHGFEGQGPEH

SEQ ID NO: 15110 - protein, 23 aa, Brucella spp.
LSGESSFHRLLWDDAQYNKDEGI

SEQ ID NO: 15111 - protein, 21 aa, Brucella spp.
IDDVYLLRVEQLYPFPAKALI

SEQ ID NO: 15112 - protein, 22 aa, Brucella spp.
LRVEQLYPFPAKALINELSRFR

SEQ ID NO: 15113 - protein, 31 aa, Brucella spp.
QEEPKNMGAWSFIDPYLEWVLAHIDAKHQRV

SEQ ID NO: 15114 - protein, 24 aa, Brucella spp.
ESVTEATIGKWFKKAGEAIAVDEP

SEQ ID NO: 15115 - protein, 18 aa, Brucella spp.
DAQNTAAMLTTFNEVDMS

SEQ ID NO: 15116 - protein, 28 aa, Brucella spp.
DVFEKKHGVKLGFMGFFTKAVTHALKEI

SEQ ID NO: 15117 - protein, 23 aa, Brucella spp.
VGTDKGLVVPVIRDADQMSIAEV

SEQ ID NO: 15118 - protein, 21 aa, Brucella spp.
QERPMVVGGQIVVRPMMYLAL

SEQ ID NO: 15119 - protein, 24 aa, Brucella spp.
QIVVRPMMYLALSYDHRIVDGKEA

SEQ ID NO: 15120 - protein, 19 aa, Brucella spp.
GKEAVTFLVRVKESLEDPE

SEQ ID NO: 15121 - protein, 18 aa, Brucella spp.
IPSKALLHASEVFAEAGH

SEQ ID NO: 15122 - protein, 20 aa, Brucella spp.
VEVTPKLNLTKMLAHKDTTV

SEQ ID NO: 15123 - protein, 24 aa, Brucella spp.
GVIGLELGSVWARLGAKVTVVEYL

SEQ ID NO: 15124 - protein, 23 aa, Brucella spp.
QRLLEKQGIAFKLGAKVTGVEKV

SEQ ID NO: 15125 - protein, 22 aa, Brucella spp.
RARAMLHTGGFVKILADKATDR

SEQ ID NO: 15126 - protein, 25 aa, Brucella spp.
GEMIHELAVLMEFGGSSEDLARTCH

SEQ ID NO: 15127 - protein, 24 aa, Brucella spp.
IAARNAAVLTLLYGCGLRISEALG

SEQ ID NO: 15128 - protein, 19 aa, Brucella spp.
YGCGLRISEALGLSGDALS

SEQ ID NO: 15129 - protein, 25 aa, Brucella spp.
ALCPFDLSAGQLLFRGAKGGPLHAA

SEQ ID NO: 15130 - protein, 20 aa, Brucella spp.
DSATPHALRHSFATHLLGRG

SEQ ID NO: 15131 - protein, 20 aa, Brucella spp.
EARVAKTVVIVRFKGVNDRN

SEQ ID NO: 15132 - protein, 17 aa, Brucella spp.
LNGTELFIDRSQLPDEE

SEQ ID NO: 15133 - protein, 30 aa, Brucella spp.
KSYGVVSAIFDFGGGDLIELSEKGKRPMLI

SEQ ID NO: 15134 - protein, 20 aa, Brucella spp.
AAVPEIDFDKGIIKVEPHAA

SEQ ID NO: 15135 - protein, 20 aa, Brucella spp.
GRFHASVLTLYPEMFPGPLG

SEQ ID NO: 15136 - protein, 26 aa, Brucella spp.
VLTLYPEMFPGPLGISLAGKALAEGK

SEQ ID NO: 15137 - protein, 18 aa, Brucella spp.
TAAIVLLDAVVRLLPGVM

SEQ ID NO: 15138 - protein, 18 aa, Brucella spp.
RENYEFAKREGFIRRESR

SEQ ID NO: 15139 - protein, 17 aa, Brucella spp.
AKREGFIRRESRLFVKL

SEQ ID NO: 15140 - protein, 19 aa, Brucella spp.
FIRRESRLFVKLASAPHGD

SEQ ID NO: 15141 - protein, 24 aa, Brucella spp.
RPLLADLDGFISIERFQSLTTPGK

SEQ ID NO: 15142 - protein, 18 aa, Brucella spp.
RAGVPFEGGGVFSNGDQA

SEQ ID NO: 15143 - protein, 17 aa, Brucella spp.
VPFEGGGVFSNGDQAIA

SEQ ID NO: 15144 - protein, 17 aa, Brucella spp.
FEGGGVFSNGDQAIAHF

SEQ ID NO: 15145 - protein, 17 aa, Brucella spp.
QAIAHFLFLDGEAAARA

SEQ ID NO: 15146 - protein, 17 aa, Brucella spp.
AEAGIPVIAIRNPLIRR

SEQ ID NO: 15147 - protein, 19 aa, Brucella spp.
AGIPVIAIRNPLIRRLKQG

SEQ ID NO: 15148 - protein, 17 aa, Brucella spp.
GLNENFTVRKISYGEGV

SEQ ID NO: 15149 - protein, 27 aa, Brucella spp.
RKISYGEGVERVFPVYSPIVEGVEVVR

SEQ ID NO: 15150 - protein, 17 aa, Brucella spp.
FPVYSPIVEGVEVVRRG

SEQ ID NO: 15151 - protein, 19 aa, Brucella spp.
KVRRAKLYYLRGLTGKAAR

SEQ ID NO: 15152 - protein, 18 aa, Brucella spp.
LYYLRGLTGKAARIAEKK

SEQ ID NO: 15153 - protein, 22 aa, Brucella spp.
LDAGSLPPIVSWGSSPEDVVSV

SEQ ID NO: 15154 - protein, 26 aa, Brucella spp.
EAEGLHKIFIEAGFDWREPGCSMCLA

SEQ ID NO: 15155 - protein, 23 aa, Brucella spp.
DWREPGCSMCLAMNDDRLKPGER

SEQ ID NO: 15156 - protein, 25 aa, Brucella spp.
GLKTACITKVFPTRSHTVAAQGGIA

SEQ ID NO: 15157 - protein, 18 aa, Brucella spp.
GPDSWQWHMYDTVKGSDW

SEQ ID NO: 15158 - protein, 19 aa, Brucella spp.
VYELEHYGVPFSRTEEGKI

SEQ ID NO: 15159 - protein, 17 aa, Brucella spp.
EHYGVPFSRTEEGKIYQ

SEQ ID NO: 15160 - protein, 22 aa, Brucella spp.
NNAQFFIEYFALDLIMTDGVCT

SEQ ID NO: 15161 - protein, 18 aa, Brucella spp.
GTIHRFSAKMVVLATGGY

SEQ ID NO: 15162 - protein, 18 aa, Brucella spp.
FSAKMVVLATGGYGRGYF

SEQ ID NO: 15163 - protein, 18 aa, Brucella spp.
FHPTGIYGAGCLITEGAR

SEQ ID NO: 15164 - protein, 18 aa, Brucella spp.
CMTMEIRAGRGVGKNKDH

SEQ ID NO: 15165 - protein, 20 aa, Brucella spp.
MGGIPTNYWGEVLNPTKEDP

SEQ ID NO: 15166 - protein, 19 aa, Brucella spp.
LGSNSLIDLVVFGRAAAIR

SEQ ID NO: 15167 - protein, 20 aa, Brucella spp.
GIGHAMEFGDWVGYGRNGKP

SEQ ID NO: 15168 - protein, 18 aa, Brucella spp.
HYHPDYYAAFVLDPDGHN

SEQ ID NO: 15169 - protein, 19 aa, Brucella spp.
EPFKWSWEMQKARGEKGEQ

SEQ ID NO: 15170 - protein, 19 aa, Brucella spp.
RLQDMSLVTSMRLSVQPVT

SEQ ID NO: 15171 - protein, 19 aa, Brucella spp.
LGDALKFAGPFLGEDGKPN

SEQ ID NO: 15172 - protein, 17 aa, Brucella spp.
LKFAGPFLGEDGKPNGS

SEQ ID NO: 15173 - protein, 17 aa, Brucella spp.
ASDPYALAGLFKDVTVR

SEQ ID NO: 15174 - protein, 24 aa, Brucella spp.
PTALPEGLHLSVFLEREDPRDAFI

SEQ ID NO: 15175 - protein, 20 aa, Brucella spp.
ACAGLRRLGLADVITDVLDP

SEQ ID NO: 15176 - protein, 18 aa, Brucella spp.
ERIDVLLAPLAHRETQIA

SEQ ID NO: 15177 - protein, 23 aa, Brucella spp.
QIALACERAFLGALDGSCRTPIA

SEQ ID NO: 15178 - protein, 24 aa, Brucella spp.
PVLLPLSRTVALSFTVPDEVFDAL

SEQ ID NO: 15179 - protein, 19 aa, Brucella spp.
VFDALTITSANAFRHIAPE

SEQ ID NO: 15180 - protein, 24 aa, Brucella spp.
PERLLPYRTLPLFAVGEGTAKAAQ

SEQ ID NO: 15181 - protein, 33 aa, Brucella spp.
VAGGVIALGGMFALQWGNVIPSPGARVTAGQLA

SEQ ID NO: 15182 - protein, 19 aa, Brucella spp.
LKTAIDRGGSFKAELDTYV

SEQ ID NO: 15183 - protein, 24 aa, Brucella spp.
GGSFKAELDTYVSVAPQDASVEGL

SEQ ID NO: 15184 - protein, 20 aa, Brucella spp.
ASVEGLRAYADKGVPTIADL

SEQ ID NO: 15185 - protein, 26 aa, Brucella spp.
KGVPTIADLNAWFGAVANRIVATENK

SEQ ID NO: 15186 - protein, 25 aa, Brucella spp.
ENKLPADASLWDQLLASARGLVSVR

SEQ ID NO: 15187 - protein, 19 aa, Brucella spp.
DRDLMLAFRRRAFQRAEPG

SEQ ID NO: 15188 - protein, 24 aa, Brucella spp.
FQRAEPGADFLLRRVADDLEKRLG

SEQ ID NO: 15189 - protein, 23 aa, Brucella spp.
AVERRFPVAVDLAGHTGAAAAAI

SEQ ID NO: 15190 - protein, 21 aa, Brucella spp.
RALKPDGLFLAALSGSGTLGE

SEQ ID NO: 15191 - protein, 25 aa, Brucella spp.
GRIRATFSIIWLSGWAPHESQQKPL

SEQ ID NO: 15192 - protein, 25 aa, Brucella spp.
PGTLCPQCWSGLRFIERPYCPVLGT

SEQ ID NO: 15193 - protein, 23 aa, Brucella spp.
ERPYCPVLGTPFGHDFGDHFLSA

SEQ ID NO: 15194 - protein, 19 aa, Brucella spp.
LAPWMARWMQRAGRELLEE

SEQ ID NO: 15195 - protein, 23 aa, Brucella spp.
ECEVVLPVPLHRWRFWRRRFNQS

SEQ ID NO: 15196 - protein, 17 aa, Brucella spp.
PYCARAKALLARKGAEF

SEQ ID NO: 15197 - protein, 18 aa, Brucella spp.
RAKALLARKGAEFNEIDA

SEQ ID NO: 15198 - protein, 20 aa, Brucella spp.
GRNTFPQIFIGSVHVGGCDD

SEQ ID NO: 15199 - protein, 19 aa, Brucella spp.
RQSEMKLVACPACHSQTVQ

SEQ ID NO: 15200 - protein, 24 aa, Brucella spp.
QNMPKVCGASSPFYDAREYDTIVA

SEQ ID NO: 15201 - protein, 18 aa, Brucella spp.
MEMGQVAVVAGFQGIGPD

SEQ ID NO: 15202 - protein, 24 aa, Brucella spp.
RLPKISFEEMLEMASLGAKVLQVR

SEQ ID NO: 15203 - protein, 25 aa, Brucella spp.
QVRSVELAMVHKVRTFVRSSFTDPD

SEQ ID NO: 15204 - protein, 17 aa, Brucella spp.
VEQQVVTGIAFAKDEAQ

SEQ ID NO: 15205 - protein, 17 aa, Brucella spp.
QQVVTGIAFAKDEAQIS

SEQ ID NO: 15206 - protein, 18 aa, Brucella spp.
VADRPGVSAAIFGPLAEE

SEQ ID NO: 15207 - protein, 19 aa, Brucella spp.
RPGVSAAIFGPLAEEHINV

SEQ ID NO: 15208 - protein, 25 aa, Brucella spp.
ITTSEIKISILIDGPYAELAVRTLH

SEQ ID NO: 15209 - protein, 19 aa, Brucella spp.
PEMLQFLGHDMIALPQDRM

SEQ ID NO: 15210 - protein, 22 aa, Brucella spp.
AVLEQDVQILLLPKDAADDKNA

SEQ ID NO: 15211 - protein, 17 aa, Brucella spp.
RAGTGGLEAALFAGDLF

SEQ ID NO: 15212 - protein, 25 aa, Brucella spp.
LEAALFAGDLFRMYERYAAEKGWRV

SEQ ID NO: 15213 - protein, 22 aa, Brucella spp.
RYAAEKGWRVELVSASEGDAGG

SEQ ID NO: 15214 - protein, 20 aa, Brucella spp.
EIIATVSGKGVFSKLKFESG

SEQ ID NO: 15215 - protein, 21 aa, Brucella spp.
KGVFSKLKFESGVHRVQRVPE

SEQ ID NO: 15216 - protein, 18 aa, Brucella spp.
HRINLTLYKLDRVMEGEL

SEQ ID NO: 15217 - protein, 23 aa, Brucella spp.
QQFTPEHILKVLIDDDEGLAASL

SEQ ID NO: 15218 - protein, 23 aa, Brucella spp.
QLYLSQPLAKVFSLAEELASKAG

SEQ ID NO: 15219 - protein, 21 aa, Brucella spp.
AIAEGLALRIVNGDVPESLKD

SEQ ID NO: 15220 - protein, 20 aa, Brucella spp.
ALDMGALIAGAKYRGEFEER

SEQ ID NO: 15221 - protein, 25 aa, Brucella spp.
KYVEKDAALARRFQPVFVDEPTVED

SEQ ID NO: 15222 - protein, 19 aa, Brucella spp.
EKQKLGLAADLKRQLEEAR

SEQ ID NO: 15223 - protein, 29 aa, Brucella spp.
TPDHVAQVISRWTGIPVDRMLEGEREKLL

SEQ ID NO: 15224 - protein, 24 aa, Brucella spp.
QDPNRPIGSFIFLGPTGVGKTELT

SEQ ID NO: 15225 - protein, 24 aa, Brucella spp.
KTELTKALASFLFQDDTAMVRIDM

SEQ ID NO: 15226 - protein, 20 aa, Brucella spp.
HSVSRLIGAPPGYVGYEEGG

SEQ ID NO: 15227 - protein, 21 aa, Brucella spp.
KAHPDVFNVLLQVLDDGRLTD

SEQ ID NO: 15228 - protein, 19 aa, Brucella spp.
QGHTVDFRNTVIIMTSNLG

SEQ ID NO: 15229 - protein, 25 aa, Brucella spp.
LNRVDEIILFHRLRREDMGAIVDIQ

SEQ ID NO: 15230 - protein, 21 aa, Brucella spp.
RREDMGAIVDIQMQRLQYLLS

SEQ ID NO: 15231 - protein, 20 aa, Brucella spp.
LEDDAREWLANKGYDPAYGA

SEQ ID NO: 15232 - protein, 21 aa, Brucella spp.
AGSDRLNFRPISGAFSAAEPE

SEQ ID NO: 15233 - protein, 17 aa, Brucella spp.
ASHPVQLAQLYDPGDEI

SEQ ID NO: 15234 - protein, 19 aa, Brucella spp.
KIAAYQVLLDRAGASPGVI

SEQ ID NO: 15235 - protein, 24 aa, Brucella spp.
NAELEATGGPAFGEYMITNEDVGR

SEQ ID NO: 15236 - protein, 18 aa, Brucella spp.
AYLKEINPDVNFNQPGSV

SEQ ID NO: 15237 - protein, 20 aa, Brucella spp.
KEINPDVNFNQPGSVVKVPN

SEQ ID NO: 15238 - protein, 17 aa, Brucella spp.
PGPNGPVGTVWIALSKP

SEQ ID NO: 15239 - protein, 17 aa, Brucella spp.
PNGPVGTVWIALSKPTY

SEQ ID NO: 15240 - protein, 18 aa, Brucella spp.
GPVGTVWIALSKPTYGIH

SEQ ID NO: 15241 - protein, 26 aa, Brucella spp.
TDPNEAFELIWQFLSLADPIFERSCD

SEQ ID NO: 15242 - protein, 27 aa, Brucella spp.
KFDSCREIPFEWQILRAEVLESLGRAE

SEQ ID NO: 15243 - protein, 20 aa, Brucella spp.
EAEEKAFAFVRAVADANHAL

SEQ ID NO: 15244 - protein, 23 aa, Brucella spp.
DANHALYFFLQYPSLSEASKLVV

SEQ ID NO: 15245 - protein, 27 aa, Brucella spp.
KLSAKFPLAATILLRAMIDFTLNNARS

SEQ ID NO: 15246 - protein, 20 aa, Brucella spp.
GALSRSIEDYHSFAPHEAYI

SEQ ID NO: 15247 - protein, 20 aa, Brucella spp.
RVRTPLGVIGVIYESRPNVT

SEQ ID NO: 15248 - protein, 22 aa, Brucella spp.
GALCLKAGNAVILRGGSDSAHS

SEQ ID NO: 15249 - protein, 25 aa, Brucella spp.
SEARVPVFAHLEGICHLYIDKSADL

SEQ ID NO: 15250 - protein, 21 aa, Brucella spp.
LDMARRIALDAKMRRTGICGA

SEQ ID NO: 15251 - protein, 17 aa, Brucella spp.
IALDAKMRRTGICGAAE

SEQ ID NO: 15252 - protein, 24 aa, Brucella spp.
WSTEYLDAIISVALVDGISGAIDH

SEQ ID NO: 15253 - protein, 24 aa, Brucella spp.
ADGGEFGMGAEIGIATGKMHARGP

SEQ ID NO: 15254 - protein, 27 aa, Brucella spp.
FALETLGFPVWAVPTVVLPWHPGHGVP

SEQ ID NO: 15255 - protein, 18 aa, Brucella spp.
TVVLPWHPGHGVPGAPAG

SEQ ID NO: 15256 - protein, 25 aa, Brucella spp.
ATPNRFELSWLTGVPLEDNKALMEA

SEQ ID NO: 15257 - protein, 22 aa, Brucella spp.
GDLTSAVFLARYLSGLSEEKTL

SEQ ID NO: 15258 - protein, 23 aa, Brucella spp.
EADVSLEVVRSFTDRVREKAVGA

SEQ ID NO: 15259 - protein, 18 aa, Brucella spp.
VNLARNFDERVGITGIVL

SEQ ID NO: 15260 - protein, 18 aa, Brucella spp.
FYPKRIADRILGMGDIVS

SEQ ID NO: 15261 - protein, 20 aa, Brucella spp.
KKLGGMGGIMGMMPGMAKMK

SEQ ID NO: 15262 - protein, 26 aa, Brucella spp.
AFAAFSQLLFEWAPPEDLAAYDAAAL

SEQ ID NO: 15263 - protein, 39 aa, Brucella spp.
TGNAAMPEAIAFLEWLRDDHFIFLGLRELVFEGTGKKRD

SEQ ID NO: 15264 - protein, 24 aa, Brucella spp.
HRCSYLDYIGVKIFGGRGEAIGEL

SEQ ID NO: 15265 - protein, 25 aa, Brucella spp.
GEAIGELRLVGLFTSVAYTSSVAGI

SEQ ID NO: 15266 - protein, 17 aa, Brucella spp.
KADAVIRHLGFNREDHS

SEQ ID NO: 15267 - protein, 26 aa, Brucella spp.
RPRVRAIPRLDRFGRFATVLVYIPRD

SEQ ID NO: 15268 - protein, 18 aa, Brucella spp.
RFATVLVYIPRDRYDSAV

SEQ ID NO: 15269 - protein, 17 aa, Brucella spp.
GGDSFEFHPVFLQNGLT

SEQ ID NO: 15270 - protein, 22 aa, Brucella spp.
DSFEFHPVFLQNGLTRVQFVIR

SEQ ID NO: 15271 - protein, 22 aa, Brucella spp.
ALAASFPPSYREIFTAPEALVD

SEQ ID NO: 15272 - protein, 23 aa, Brucella spp.
LSPEEPLFVDFYRYRTDGPDAVS

SEQ ID NO: 15273 - protein, 22 aa, Brucella spp.
QRVPLLENMGFRVVSEQTIDLP

SEQ ID NO: 15274 - protein, 24 aa, Brucella spp.
YPEIASDLYALFDLRSNPSSKRRD

SEQ ID NO: 15275 - protein, 25 aa, Brucella spp.
GKPRVTFAFKLNPRLVDGLPEPRPY

SEQ ID NO: 15276 - protein, 21 aa, Brucella spp.
LPEPRPYREIFVYGPEVEGVH

SEQ ID NO: 15277 - protein, 17 aa, Brucella spp.
EGVHLRFGAVARGGLRW

SEQ ID NO: 15278 - protein, 22 aa, Brucella spp.
VHLRFGAVARGGLRWSDRAQDY

SEQ ID NO: 15279 - protein, 17 aa, Brucella spp.
VIVPVGAKGGFYPKRLP

SEQ ID NO: 15280 - protein, 19 aa, Brucella spp.
GAKGGFYPKRLPVGGDRNA

SEQ ID NO: 15281 - protein, 18 aa, Brucella spp.
RDAYKVFISTLLSVTDNI

SEQ ID NO: 15282 - protein, 24 aa, Brucella spp.
MLLSEQIRLVAAFDHRDIFIDPNP

SEQ ID NO: 15283 - protein, 17 aa, Brucella spp.
LSAEASAAISLGKTTAT

SEQ ID NO: 15284 - protein, 27 aa, Brucella spp.
TAILKSKVDLLWFGGIGTYIRSSAETD

SEQ ID NO: 15285 - protein, 24 aa, Brucella spp.
DVEVNIKIALAAAMRSGKLKRPAR

SEQ ID NO: 15286 - protein, 25 aa, Brucella spp.
PLTRPELAVLLAYAKLSLLDDLVAS

SEQ ID NO: 15287 - protein, 23 aa, Brucella spp.
LPDEPYFQSLLFGYFPKRMAKTY

SEQ ID NO: 15288 - protein, 21 aa, Brucella spp.
GEMLQATTAWVLRNDTTRANL

SEQ ID NO: 15289 - protein, 17 aa, Brucella spp.
GLMPEYLKSALQADKAA

SEQ ID NO: 15290 - protein, 21 aa, Brucella spp.
ADIMPDIALIAHLAGADVVAA

SEQ ID NO: 15291 - protein, 22 aa, Brucella spp.
AYFAVSEAFRIGRIEDAARSIP

SEQ ID NO: 15292 - protein, 18 aa, Brucella spp.
IPVADYYDGLALSRASDT

SEQ ID NO: 15293 - protein, 17 aa, Brucella spp.
RGITIAALKRFAKEKDP

SEQ ID NO: 15294 - protein, 17 aa, Brucella spp.
ITIAALKRFAKEKDPAA

SEQ ID NO: 15295 - protein, 17 aa, Brucella spp.
IAALKRFAKEKDPAAAW

SEQ ID NO: 15296 - protein, 25 aa, Brucella spp.
IPVKDVSEITGFPEIMDGRVKTLHP

SEQ ID NO: 15297 - protein, 27 aa, Brucella spp.
GIGGIDLAVINLYPFEEVRFKGGDYDT

SEQ ID NO: 15298 - protein, 26 aa, Brucella spp.
ELEKHSGSLPLAFRKKLAAKAFSRTA

SEQ ID NO: 15299 - protein, 17 aa, Brucella spp.
AAISNWFAEAIDEETPT

SEQ ID NO: 15300 - protein, 23 aa, Brucella spp.
TDAAFELVAEFDPARTAAVAIIK

SEQ ID NO: 15301 - protein, 17 aa, Brucella spp.
LACDPVSAFGGIVALNR

SEQ ID NO: 15302 - protein, 17 aa, Brucella spp.
VSAFGGIVALNRTLDEE

SEQ ID NO: 15303 - protein, 24 aa, Brucella spp.
EAELNDLKFAFRVGKHVKSNAIVY

SEQ ID NO: 15304 - protein, 26 aa, Brucella spp.
TKGCVVASDAFFPFADGLLSAVEAGA

SEQ ID NO: 15305 - protein, 23 aa, Brucella spp.
PHLWGLAIAQAWRKFSRRLRMGP

SEQ ID NO: 15306 - protein, 23 aa, Brucella spp.
RRLRMGPLYRWRFTGFTPDRILI

SEQ ID NO: 15307 - protein, 21 aa, Brucella spp.
FYHGRFALAGRLVETGGLSPF

SEQ ID NO: 15308 - protein, 23 aa, Brucella spp.
PEWEAALQGFGWLRHLKSANSEL

SEQ ID NO: 15309 - protein, 22 aa, Brucella spp.
WAPEVTAQRIIAWLQHSNLILS

SEQ ID NO: 15310 - protein, 25 aa, Brucella spp.
ILSGAELPAYRKFMRSLAMQVRYLR

SEQ ID NO: 15311 - protein, 17 aa, Brucella spp.
FMRSLAMQVRYLRTVAA

SEQ ID NO: 15312 - protein, 21 aa, Brucella spp.
ERLRARIALAFAALALPVSPP

SEQ ID NO: 15313 - protein, 20 aa, Brucella spp.
AVERMLPALRFFRHQDGSLA

SEQ ID NO: 15314 - protein, 17 aa, Brucella spp.
LPALRFFRHQDGSLALF

SEQ ID NO: 15315 - protein, 21 aa, Brucella spp.
PQLEDSIFFAGFRGPVTSKQI

SEQ ID NO: 15316 - protein, 18 aa, Brucella spp.
SDLPEVNWQFSRVALGSY

SEQ ID NO: 15317 - protein, 27 aa, Brucella spp.
RPGLAARLCAARLLGAVIEKNTSLDGL

SEQ ID NO: 15318 - protein, 26 aa, Brucella spp.
ALKHLLHVAVAQIFYLDLPDHSAVDL

SEQ ID NO: 15319 - protein, 17 aa, Brucella spp.
RKYAGLVNALLRRLARN

SEQ ID NO: 15320 - protein, 19 aa, Brucella spp.
YAGLVNALLRRLARNKERA

SEQ ID NO: 15321 - protein, 23 aa, Brucella spp.
FEPEANVPEWFAKSITDAYGTEK

SEQ ID NO: 15322 - protein, 22 aa, Brucella spp.
MHAYEPPIDFTVKGDAKAWAEK

SEQ ID NO: 15323 - protein, 18 aa, Brucella spp.
LTDLPGFAEGEWWVQDVA

SEQ ID NO: 15324 - protein, 19 aa, Brucella spp.
GFAEGEWWVQDVAASLPAR

SEQ ID NO: 15325 - protein, 19 aa, Brucella spp.
FKPDELFDAVLLDAPCSST

SEQ ID NO: 15326 - protein, 22 aa, Brucella spp.
KAPENPLLEPFPITEQDCPGLE

SEQ ID NO: 15327 - protein, 18 aa, Brucella spp.
PGLEGLVTAEGFLRSTPA

SEQ ID NO: 15328 - protein, 24 aa, Brucella spp.
MPDHPHLLQLFVWQDYDLAPEFPV

SEQ ID NO: 15329 - protein, 22 aa, Brucella spp.
APEFPVLNHFIEFWQREIEGPL

SEQ ID NO: 15330 - protein, 18 aa, Brucella spp.
YYVLEMFPYPSGRIHMGH

SEQ ID NO: 15331 - protein, 25 aa, Brucella spp.
KRAKGFNVLHPMGWDAFGMPAENAA

SEQ ID NO: 15332 - protein, 27 aa, Brucella spp.
RQLKSMGLSLDWSREFATCDVEYYHRQ

SEQ ID NO: 15333 - protein, 19 aa, Brucella spp.
EGLQVRFALAAGTAPAGFS

SEQ ID NO: 15334 - protein, 22 aa, Brucella spp.
NWELPVYVANFVLMEYGTGAVF

SEQ ID NO: 15335 - protein, 17 aa, Brucella spp.
VLMEYGTGAVFGCPAHD

SEQ ID NO: 15336 - protein, 17 aa, Brucella spp.
MEYGTGAVFGCPAHDQR

SEQ ID NO: 15337 - protein, 18 aa, Brucella spp.
YGTGAVFGCPAHDQRDLD

SEQ ID NO: 15338 - protein, 18 aa, Brucella spp.
FANKYKLKVTPVVLPKGE

SEQ ID NO: 15339 - protein, 27 aa, Brucella spp.
RDWGISRQRYWGCPIPMIHCESCGVNP

SEQ ID NO: 15340 - protein, 25 aa, Brucella spp.
IEHAILHLLYSRFFTRAMKVAGHVG

SEQ ID NO: 15341 - protein, 17 aa, Brucella spp.
ADTARWFVLSDSPPERD

SEQ ID NO: 15342 - protein, 20 aa, Brucella spp.
AEGAHRFVQRIWRLVAEAAP

SEQ ID NO: 15343 - protein, 22 aa, Brucella spp.
REATEMLVLMTAPMMPHLAEQC

SEQ ID NO: 15344 - protein, 24 aa, Brucella spp.
GKETLVARAPWPVFDPALVVENEI

SEQ ID NO: 15345 - protein, 19 aa, Brucella spp.
QMMKEAAVIARIADNICIK

SEQ ID NO: 15346 - protein, 17 aa, Brucella spp.
AAVIARIADNICIKLPV

SEQ ID NO: 15347 - protein, 23 aa, Brucella spp.
ADNICIKLPVTLDGLKACKALTS

SEQ ID NO: 15348 - protein, 24 aa, Brucella spp.
EGHKVNMTLCFSANQALLAAKAGA

SEQ ID NO: 15349 - protein, 17 aa, Brucella spp.
YDNYDFRTEILAASVRT

SEQ ID NO: 15350 - protein, 20 aa, Brucella spp.
MVEFPGGIRGMALNLESDNV

SEQ ID NO: 15351 - protein, 19 aa, Brucella spp.
DPAPMQYLAPFAGCAMGEY

SEQ ID NO: 15352 - protein, 19 aa, Brucella spp.
LAPFAGCAMGEYFRDNGQH

SEQ ID NO: 15353 - protein, 24 aa, Brucella spp.
PGREAYPGDVFYLHSRLLERAAKL

SEQ ID NO: 15354 - protein, 18 aa, Brucella spp.
FLETNLFYQGIRPAVNVG

SEQ ID NO: 15355 - protein, 17 aa, Brucella spp.
FYQGIRPAVNVGLSVSR

SEQ ID NO: 15356 - protein, 24 aa, Brucella spp.
LAQYREMAAFAQFGSDLDAATQRL

SEQ ID NO: 15357 - protein, 18 aa, Brucella spp.
RLTELLKQPQFSPLKTEE

SEQ ID NO: 15358 - protein, 19 aa, Brucella spp.
IGHKIIKLFEEGAFDVCTL

SEQ ID NO: 15359 - protein, 19 aa, Brucella spp.
FDVCTLFYSEFKSVISQVS

SEQ ID NO: 15360 - protein, 18 aa, Brucella spp.
LFYSEFKSVISQVSTAQQ

SEQ ID NO: 15361 - protein, 21 aa, Brucella spp.
YEPDPAAILSTLIPRNISVQI

SEQ ID NO: 15362 - protein, 25 aa, Brucella spp.
TLIPRNISVQIFRALLENVAGEMGA

SEQ ID NO: 15363 - protein, 18 aa, Brucella spp.
TQVIGAVVDVKFPEGQLP

SEQ ID NO: 15364 - protein, 27 aa, Brucella spp.
VVDVKFPEGQLPLILNALEVDNQGHRL

SEQ ID NO: 15365 - protein, 19 aa, Brucella spp.
PIMVPVGVETLGRIMNVIG

SEQ ID NO: 15366 - protein, 19 aa, Brucella spp.
VTGIKVVDLLAPYAKGGKI

SEQ ID NO: 15367 - protein, 18 aa, Brucella spp.
VVDLLAPYAKGGKIGLFG

SEQ ID NO: 15368 - protein, 19 aa, Brucella spp.
RVALSGLTVAENFRDQGQD

SEQ ID NO: 15369 - protein, 21 aa, Brucella spp.
QGQDVLFFVDNIFRFTQAGSE

SEQ ID NO: 15370 - protein, 20 aa, Brucella spp.
FFVDNIFRFTQAGSEVSALL

SEQ ID NO: 15371 - protein, 18 aa, Brucella spp.
SALLGRIPSAVGYQPTLA

SEQ ID NO: 15372 - protein, 23 aa, Brucella spp.
QRYKALQDIIAILGMDELSEEDK

SEQ ID NO: 15373 - protein, 17 aa, Brucella spp.
SEEDKLTVARARKIERF

SEQ ID NO: 15374 - protein, 30 aa, Brucella spp.
RARKIERFLSQPFFVAEVFTGSPGKLVDLA

SEQ ID NO: 15375 - protein, 24 aa, Brucella spp.
DYDHLPEAAFYMVGSIEEALEKAK

SEQ ID NO: 15376 - protein, 24 aa, Brucella spp.
DGKTDSYVVFGGFADITPQGCTVL

SEQ ID NO: 15377 - protein, 18 aa, Brucella spp.
ANELGLKTVTIWAEEDKL

SEQ ID NO: 15378 - protein, 19 aa, Brucella spp.
ACAENGIVFIGPKPETMRR

SEQ ID NO: 15379 - protein, 28 aa, Brucella spp.
LAAQIGYPLMLKASWGGGGRGMRAIRAE

SEQ ID NO: 15380 - protein, 20 aa, Brucella spp.
ADTGKFYFIEVNPRIQVEHT

SEQ ID NO: 15381 - protein, 25 aa, Brucella spp.
RIQAYRSAAGFGIRLDGGTAYSGAF

SEQ ID NO: 15382 - protein, 24 aa, Brucella spp.
EFRIRGVATNLTFLEAIINHPKFL

SEQ ID NO: 15383 - protein, 19 aa, Brucella spp.
AKPRVPWFGDKLVADGTKQ

SEQ ID NO: 15384 - protein, 30 aa, Brucella spp.
AQALPNLFSLECWGGATFDVSMRFLTEDPW

SEQ ID NO: 15385 - protein, 18 aa, Brucella spp.
FDVSMRFLTEDPWERLAL

SEQ ID NO: 15386 - protein, 19 aa, Brucella spp.
FLTEDPWERLALVREGAPN

SEQ ID NO: 15387 - protein, 24 aa, Brucella spp.
REGAPNLLLQMLLRGANGVGYKSY

SEQ ID NO: 15388 - protein, 21 aa, Brucella spp.
SYPDNVVKYFVREAARAGIDL

SEQ ID NO: 15389 - protein, 25 aa, Brucella spp.
AGIDLFRVFDSLNWVENMRVSMDAV

SEQ ID NO: 15390 - protein, 20 aa, Brucella spp.
KLCEAAICYTGDILNPDRAK

SEQ ID NO: 15391 - protein, 22 aa, Brucella spp.
GLLKPAAARVLFKALREETDLP

SEQ ID NO: 15392 - protein, 25 aa, Brucella spp.
LDPDLIRRISFYWEAVRHQYAAFES

SEQ ID NO: 15393 - protein, 24 aa, Brucella spp.
KEQARSLGLETRWHEVAQAYADVN

SEQ ID NO: 15394 - protein, 22 aa, Brucella spp.
DQEFASALMYPKVFTDYATAHE

SEQ ID NO: 15395 - protein, 21 aa, Brucella spp.
SVLPTPVYFYGLKPEEEVFVD

SEQ ID NO: 15396 - protein, 18 aa, Brucella spp.
KGMVTVFFELNGQPRRIK

SEQ ID NO: 15397 - protein, 24 aa, Brucella spp.
LGHDVPLVGDFHYIGHKLLADHPA

SEQ ID NO: 15398 - protein, 24 aa, Brucella spp.
IRYDKPVRIGVNWGSLDQELLTTL

SEQ ID NO: 15399 - protein, 25 aa, Brucella spp.
QVAQELLQTMGFRQFVPIVAACPGC

SEQ ID NO: 15400 - protein, 18 aa, Brucella spp.
GASMLRFEIGSGKAYGAL

SEQ ID NO: 15401 - protein, 25 aa, Brucella spp.
DENDIAIGDRFRFGTALIEVSQGRQ

SEQ ID NO: 15402 - protein, 19 aa, Brucella spp.
GRQPCWKLNVRFDRPDMAV

SEQ ID NO: 15403 - protein, 17 aa, Brucella spp.
WKLNVRFDRPDMAVHVQ

SEQ ID NO: 15404 - protein, 25 aa, Brucella spp.
RLSPEWTLHRIWHLLYVDMLNYDEL

SEQ ID NO: 15405 - protein, 18 aa, Brucella spp.
LPPADRPVSMVFQENNLF

SEQ ID NO: 15406 - protein, 17 aa, Brucella spp.
RERPVLLLDEAFASLGP

SEQ ID NO: 15407 - protein, 23 aa, Brucella spp.
EDALHLDALLIFLDNGKIAAQGP

SEQ ID NO: 15408 - protein, 22 aa, Brucella spp.
AEEAWPLPPGDYIYDFPDGTPF

SEQ ID NO: 15409 - protein, 25 aa, Brucella spp.
DYIYDFPDGTPFSVINFSTVEGLSI

SEQ ID NO: 15410 - protein, 17 aa, Brucella spp.
LRVTVRSGLAILIANLG

SEQ ID NO: 15411 - protein, 18 aa, Brucella spp.
AQTIAVGQLRAFIERIER

SEQ ID NO: 15412 - protein, 18 aa, Brucella spp.
VGQLRAFIERIERLEEEK

SEQ ID NO: 15413 - protein, 19 aa, Brucella spp.
FDSKVVRTIIRLRKKEDHE

SEQ ID NO: 15414 - protein, 19 aa, Brucella spp.
EKLPLAAPLTPVHTGAGVS

SEQ ID NO: 15415 - protein, 24 aa, Brucella spp.
KARRIAAQINMLWSQSGSATVDLL

SEQ ID NO: 15416 - protein, 18 aa, Brucella spp.
VDLLMQWANKAMLEHRYP

SEQ ID NO: 15417 - protein, 18 aa, Brucella spp.
HRYPSAIDFLNEAIALDP

SEQ ID NO: 15418 - protein, 18 aa, Brucella spp.
DYAEAWNRRATVYFLQKD

SEQ ID NO: 15419 - protein, 17 aa, Brucella spp.
CHYGALTGMAAILRARG

SEQ ID NO: 15420 - protein, 18 aa, Brucella spp.
YEQALSIYPMMRDAQKNF

SEQ ID NO: 15421 - protein, 27 aa, Brucella spp.
LLHALDYVGVLGLEFFVLKDGTLLANE

SEQ ID NO: 15422 - protein, 17 aa, Brucella spp.
LKDGTLLANEFAPRVHN

SEQ ID NO: 15423 - protein, 17 aa, Brucella spp.
DGTLLANEFAPRVHNSG

SEQ ID NO: 15424 - protein, 22 aa, Brucella spp.
AKAEGFKVIIAGAGGAAHLPGM

SEQ ID NO: 15425 - protein, 20 aa, Brucella spp.
YDEALAARLDEWRKAQTESV

SEQ ID NO: 15426 - protein, 20 aa, Brucella spp.
PPTAQLLGWELIDVDVEQGT

SEQ ID NO: 15427 - protein, 24 aa, Brucella spp.
TIDLNVSFIRPVQPGRVIAEGRVV

SEQ ID NO: 15428 - protein, 18 aa, Brucella spp.
EAVDLRLDKEGDFAEAEE

SEQ ID NO: 15429 - protein, 29 aa, Brucella spp.
NSFGEIGDLRLTVMAGIMVMDELAEMQKR

SEQ ID NO: 15430 - protein, 17 aa, Brucella spp.
IAVPAGVMIAGYWPIRS

SEQ ID NO: 15431 - protein, 22 aa, Brucella spp.
VPAGVMIAGYWPIRSEIDPRPL

SEQ ID NO: 15432 - protein, 17 aa, Brucella spp.
LPVVLDAETIAFREFLP

SEQ ID NO: 15433 - protein, 22 aa, Brucella spp.
AERGLQPLLIGMAFDCQEVDYV

SEQ ID NO: 15434 - protein, 23 aa, Brucella spp.
VAEMRAALEVLALRHAAPHITRA

SEQ ID NO: 15435 - protein, 19 aa, Brucella spp.
ILTPCKMPRLLAAIDDLHA

SEQ ID NO: 15436 - protein, 25 aa, Brucella spp.
DDLHAASARFLFATWRSAWEARTDH

SEQ ID NO: 15437 - protein, 19 aa, Brucella spp.
SAATILARHVQWIGHRPVK

SEQ ID NO: 15438 - protein, 23 aa, Brucella spp.
SFLYEQGEALIFMDTETYEQLEL

SEQ ID NO: 15439 - protein, 21 aa, Brucella spp.
KPIGIRLPDQVTLAITEADPV

SEQ ID NO: 15440 - protein, 17 aa, Brucella spp.
LPDQVTLAITEADPVVK

SEQ ID NO: 15441 - protein, 21 aa, Brucella spp.
LENGIRIPVPPFIASGERVIV

SEQ ID NO: 15442 - protein, 17 aa, Brucella spp.
FSDSFKPIYAQGMDMVE

SEQ ID NO: 15443 - protein, 22 aa, Brucella spp.
TTRLMQIASWLLLQRAARSGEM

SEQ ID NO: 15444 - protein, 24 aa, Brucella spp.
PGWNELPLAFVDLVERSMRLQARV

SEQ ID NO: 15445 - protein, 24 aa, Brucella spp.
TATLKLGQARGIALLAPAQAGLPV

SEQ ID NO: 15446 - protein, 29 aa, Brucella spp.
MIRLYGFATQLEREWFRLLQNVQGVGAKV

SEQ ID NO: 15447 - protein, 23 aa, Brucella spp.
LSPSELANAIALRDIAMVSRAPG

SEQ ID NO: 15448 - protein, 18 aa, Brucella spp.
AMEDFQLDLIIGEGPAAR

SEQ ID NO: 15449 - protein, 26 aa, Brucella spp.
PLRDRFGIPVRLNFYTVEELEYIVRR

SEQ ID NO: 15450 - protein, 17 aa, Brucella spp.
VGRLLRRVRDFALVAGA

SEQ ID NO: 15451 - protein, 17 aa, Brucella spp.
RLLRRVRDFALVAGADI

SEQ ID NO: 15452 - protein, 17 aa, Brucella spp.
RDFALVAGADIIDRRIA

SEQ ID NO: 15453 - protein, 20 aa, Brucella spp.
DRRYLNIIARNFGGGPVGIE

SEQ ID NO: 15454 - protein, 19 aa, Brucella spp.
DIIEPYLIQQGFLQRTPRG

SEQ ID NO: 15455 - protein, 21 aa, Brucella spp.
LKDGAHLLYARIYYADTDFSG

SEQ ID NO: 15456 - protein, 18 aa, Brucella spp.
LAEGSLGEEMVWVVRHME

SEQ ID NO: 15457 - protein, 18 aa, Brucella spp.
LGLLFLLKDYLSTLESPP

SEQ ID NO: 15458 - protein, 18 aa, Brucella spp.
PPVLIAVTVDHKLRAESA

SEQ ID NO: 15459 - protein, 23 aa, Brucella spp.
QDAPRRLTVFGALIERGEKGAPH

SEQ ID NO: 15460 - protein, 19 aa, Brucella spp.
KLDLVPGQHIVWDGRFCFF

SEQ ID NO: 15461 - protein, 22 aa, Brucella spp.
SRRCEALLISPALYEGGKLAFV

SEQ ID NO: 15462 - protein, 22 aa, Brucella spp.
EGGKLAFVPFLPGAEWPQGVHI

SEQ ID NO: 15463 - protein, 26 aa, Brucella spp.
FLPGAEWPQGVHIERHFAIFDHVLPG

SEQ ID NO: 15464 - protein, 19 aa, Brucella spp.
LQVPADYRIGIVPASDTGA

SEQ ID NO: 15465 - protein, 23 aa, Brucella spp.
GAVEMALWSMLGARGVDMVAWES

SEQ ID NO: 15466 - protein, 17 aa, Brucella spp.
LDFAKLDVVTFSWQKVL

SEQ ID NO: 15467 - protein, 18 aa, Brucella spp.
FAKLDVVTFSWQKVLGGE

SEQ ID NO: 15468 - protein, 21 aa, Brucella spp.
GEGAHGILILSPRAVERLESY

SEQ ID NO: 15469 - protein, 24 aa, Brucella spp.
LESYKPAWPLPKIFRMTKGGKLIE

SEQ ID NO: 15470 - protein, 17 aa, Brucella spp.
LPKIFRMTKGGKLIEGI

SEQ ID NO: 15471 - protein, 19 aa, Brucella spp.
YLDALKWAKSLGGLDALIA

SEQ ID NO: 15472 - protein, 18 aa, Brucella spp.
APSGLRIWAGATVEASDL

SEQ ID NO: 15473 - protein, 22 aa, Brucella spp.
SDLEALTHWLNWAFATQKAALK

SEQ ID NO: 15474 - protein, 20 aa, Brucella spp.
GVSYKLSLLPSGLVRGKLSV

SEQ ID NO: 15475 - protein, 19 aa, Brucella spp.
VAENAPLILSIHRELDAMR

SEQ ID NO: 15476 - protein, 24 aa, Brucella spp.
DERRKAGARILFEGAQGALLDNDH

SEQ ID NO: 15477 - protein, 21 aa, Brucella spp.
GEGPFPTELNDEIGEFLGTKG

SEQ ID NO: 15478 - protein, 23 aa, Brucella spp.
LEEIKICVAYELDGKRIDYLPSS

SEQ ID NO: 15479 - protein, 17 aa, Brucella spp.
LILEIPQGYEVQIRPRS

SEQ ID NO: 15480 - protein, 22 aa, Brucella spp.
YRGEVKVLLINLGDDDFRIERG

SEQ ID NO: 15481 - protein, 20 aa, Brucella spp.
PHLPYLRRFSRALTGSQSSG

SEQ ID NO: 15482 - protein, 18 aa, Brucella spp.
ASSDRIGLYRLFCNLYKN

SEQ ID NO: 15483 - protein, 18 aa, Brucella spp.
TSSEFAWETHAARNLAHI

SEQ ID NO: 15484 - protein, 26 aa, Brucella spp.
AHIAPLPRQAFLLVAVEGFNDHEAAE

SEQ ID NO: 15485 - protein, 25 aa, Brucella spp.
HDNTIPVIFITAFPERLLTGERPEP

SEQ ID NO: 15486 - protein, 24 aa, Brucella spp.
AGKRLDQWLAAALGPELSRSRVQS

SEQ ID NO: 15487 - protein, 21 aa, Brucella spp.
KLREGMNIAIVLPEPEPAEPQ

SEQ ID NO: 15488 - protein, 21 aa, Brucella spp.
QGENIPLDILYEDDDLIVINK

SEQ ID NO: 15489 - protein, 24 aa, Brucella spp.
TGDLERAYLALVWGMTERPQGTVD

SEQ ID NO: 15490 - protein, 23 aa, Brucella spp.
FHRQALHAWLLAFTHPITEELMR

SEQ ID NO: 15491 - protein, 21 aa, Brucella spp.
SHLRLVAKIAMGYRGYGLPIG

SEQ ID NO: 15492 - protein, 27 aa, Brucella spp.
EPERGFRLATYAMWWIKASIQEYILRS

SEQ ID NO: 15493 - protein, 22 aa, Brucella spp.
KASIQEYILRSWSLVKMGTTAN

SEQ ID NO: 15494 - protein, 22 aa, Brucella spp.
TEADLPALLAIYNDAVENTLAI

SEQ ID NO: 15495 - protein, 18 aa, Brucella spp.
ASYGPFRPFEGFRHSSEL

SEQ ID NO: 15496 - protein, 22 aa, Brucella spp.
LAVAPELVEFLAKEAAPGTGVE

SEQ ID NO: 15497 - protein, 22 aa, Brucella spp.
GVEPEKFWKGFAAIIRDLAPKN

SEQ ID NO: 15498 - protein, 19 aa, Brucella spp.
IGYLLPEGGAFSVSTTNVD

SEQ ID NO: 15499 - protein, 23 aa, Brucella spp.
KRGEKVIAWAKNFLDESAPLSTG

SEQ ID NO: 15500 - protein, 22 aa, Brucella spp.
AEDKVAVYRNWLGLMNGKLEDT

SEQ ID NO: 15501 - protein, 20 aa, Brucella spp.
HGPEEVAFANEIFTRTEEML

SEQ ID NO: 15502 - protein, 20 aa, Brucella spp.
GDMKQAAWIGAYEQWNVDIG

SEQ ID NO: 15503 - protein, 20 aa, Brucella spp.
QWNVDIGLECGLSGHAQIGK

SEQ ID NO: 15504 - protein, 21 aa, Brucella spp.
KGMWAMPDMMAAMLEQKIAHP

SEQ ID NO: 15505 - protein, 20 aa, Brucella spp.
DILSVPVAVRPNWTPDDIQH

SEQ ID NO: 15506 - protein, 20 aa, Brucella spp.
NNAQGILGYVVRWIDQGVGC

SEQ ID NO: 15507 - protein, 19 aa, Brucella spp.
ILGYVVRWIDQGVGCSKVP

SEQ ID NO: 15508 - protein, 20 aa, Brucella spp.
ISAQHIANWLYHGVVSEAQV

SEQ ID NO: 15509 - protein, 32 aa, Brucella spp.
RPMAADFDKSIAFQAACDLVFKGREQPNGYTE

SEQ ID NO: 15510 - protein, 21 aa, Brucella spp.
AEQSGGRFLLRMEDIDTARCT

SEQ ID NO: 15511 - protein, 29 aa, Brucella spp.
PALEQGIYDDLHWLGLRWETPVRRQSEHF

SEQ ID NO: 15512 - protein, 22 aa, Brucella spp.
LADKGLVYPAFLSRSEVRKRIS

SEQ ID NO: 15513 - protein, 26 aa, Brucella spp.
MEHIVSGAPYAWRLDMDKALASAGEP

SEQ ID NO: 15514 - protein, 19 aa, Brucella spp.
SAGEPLFWNESGAGPDGET

SEQ ID NO: 15515 - protein, 18 aa, Brucella spp.
DTALASLLEQGWTPADIR

SEQ ID NO: 15516 - protein, 25 aa, Brucella spp.
YSLAEMGANRLWKLIHEEDFVNALG

SEQ ID NO: 15517 - protein, 20 aa, Brucella spp.
WKLIHEEDFVNALGALSGNQ

SEQ ID NO: 15518 - protein, 23 aa, Brucella spp.
RAGLKAIYLSGWQVAADANTASA

SEQ ID NO: 15519 - protein, 18 aa, Brucella spp.
AEGKGLSVDTWFAPIVAD

SEQ ID NO: 15520 - protein, 18 aa, Brucella spp.
LSVDTWFAPIVADAEAGF

SEQ ID NO: 15521 - protein, 17 aa, Brucella spp.
ADAEAGFGDPLDAFEIM

SEQ ID NO: 15522 - protein, 33 aa, Brucella spp.
KNGIEPCIARAIAYAPYCDLIWMETSKPDLAQA

SEQ ID NO: 15523 - protein, 18 aa, Brucella spp.
LAQARRFAEAVHKAHPGK

SEQ ID NO: 15524 - protein, 25 aa, Brucella spp.
GKLLAYNCSPSFNWKKNLDDATIAK

SEQ ID NO: 15525 - protein, 30 aa, Brucella spp.
QRELGAMGYKFQFITLAGFHQLNYGMFELA

SEQ ID NO: 15526 - protein, 19 aa, Brucella spp.
PDGVAALLVATQMPDNSAE

SEQ ID NO: 15527 - protein, 20 aa, Brucella spp.
VVAASPRFALLDISASTLED

SEQ ID NO: 15528 - protein, 24 aa, Brucella spp.
RLTDTPALHLLCIVGDAPAQFQTA

SEQ ID NO: 15529 - protein, 27 aa, Brucella spp.
FDHDAPPARFIWKVGPDGTFSEISPDL

SEQ ID NO: 15530 - protein, 24 aa, Brucella spp.
GRRFSDVANVFGFDTDGSIAALLL

SEQ ID NO: 15531 - protein, 32 aa, Brucella spp.
WPVEGTRLRVPVELAALPVYSRDREFLGFRGF

SEQ ID NO: 15532 - protein, 25 aa, Brucella spp.
YSRDREFLGFRGFGIVRPAEAEADP

SEQ ID NO: 15533 - protein, 17 aa, Brucella spp.
EEIGLALAGGIPQNRKP

SEQ ID NO: 15534 - protein, 17 aa, Brucella spp.
IGLALAGGIPQNRKPRK

SEQ ID NO: 15535 - protein, 19 aa, Brucella spp.
TALLANLPVPVIIHSGDAI

SEQ ID NO: 15536 - protein, 27 aa, Brucella spp.
EPVDAHLNAIAWRGGRALMLSLMPVTA

SEQ ID NO: 15537 - protein, 19 aa, Brucella spp.
SMNHSASALFGYERDEAEG

SEQ ID NO: 15538 - protein, 25 aa, Brucella spp.
RDEAEGKFFSMLFAIESQRAAMDYL

SEQ ID NO: 15539 - protein, 24 aa, Brucella spp.
GREAKGGFIPLFMTIGKLPHTRGF

SEQ ID NO: 15540 - protein, 23 aa, Brucella spp.
HEIRTPLNAIIGFSELMADEKFG

SEQ ID NO: 15541 - protein, 19 aa, Brucella spp.
EGTGLGLPLTKAMVEANRA

SEQ ID NO: 15542 - protein, 17 aa, Brucella spp.
FVPSFTFAATAEVVALV

SEQ ID NO: 15543 - protein, 28 aa, Brucella spp.
GRLEPKAIIPVDLFGLAASYNRITAIAE

SEQ ID NO: 15544 - protein, 20 aa, Brucella spp.
CGAFGHVGATSFYPAKPLGC

SEQ ID NO: 15545 - protein, 17 aa, Brucella spp.
GATSFYPAKPLGCYGDG

SEQ ID NO: 15546 - protein, 19 aa, Brucella spp.
ELADILRSVLFHGKGETQY

SEQ ID NO: 15547 - protein, 21 aa, Brucella spp.
SESLPSRILSLPMHPYLSEAD

SEQ ID NO: 15548 - protein, 17 aa, Brucella spp.
INHFAYPTFAKAARQRR

SEQ ID NO: 15549 - protein, 18 aa, Brucella spp.
HFAYPTFAKAARQRRDNL

SEQ ID NO: 15550 - protein, 21 aa, Brucella spp.
KREGYDVVGVTLQLYDHGAAV

SEQ ID NO: 15551 - protein, 17 aa, Brucella spp.
GIPHYVLDYEARFREAV

SEQ ID NO: 15552 - protein, 21 aa, Brucella spp.
VLDYEARFREAVIDPFANSYV

SEQ ID NO: 15553 - protein, 24 aa, Brucella spp.
IPCVSCNQTVKFADLLQTARDLGA

SEQ ID NO: 15554 - protein, 20 aa, Brucella spp.
IDYLRFPLGHLPKAQVREIA

SEQ ID NO: 15555 - protein, 17 aa, Brucella spp.
FPLGHLPKAQVREIAEE

SEQ ID NO: 15556 - protein, 18 aa, Brucella spp.
VATGEALYVVHLDAANAR

SEQ ID NO: 15557 - protein, 26 aa, Brucella spp.
EALETHKVFLRDVNWLGDTPIADLPK

SEQ ID NO: 15558 - protein, 25 aa, Brucella spp.
DDSNAACVFGGGFIGRSEREPQAEE

SEQ ID NO: 15559 - protein, 19 aa, Brucella spp.
ESCPEFAPQSMLDVGAGPG

SEQ ID NO: 15560 - protein, 17 aa, Brucella spp.
QCWPELQSATMIEASPA

SEQ ID NO: 15561 - protein, 23 aa, Brucella spp.
ARHSGLTMLDWRAGDVVRERLEF

SEQ ID NO: 15562 - protein, 26 aa, Brucella spp.
RERLEFPYADLVTIAYVLDELAPDER

SEQ ID NO: 15563 - protein, 17 aa, Brucella spp.
GTPAGWRRILDARKALI

SEQ ID NO: 15564 - protein, 25 aa, Brucella spp.
HGLDCPLVAPDWCHFSQRVARSRIH

SEQ ID NO: 15565 - protein, 18 aa, Brucella spp.
WEDEKFVYLAAVREKPAG

SEQ ID NO: 15566 - protein, 25 aa, Brucella spp.
RKERMFRLLIDMGFPEIEIGFPSAS

SEQ ID NO: 15567 - protein, 20 aa, Brucella spp.
IEIGFPSASQTDFDFCRWAI

SEQ ID NO: 15568 - protein, 19 aa, Brucella spp.
SASQTDFDFCRWAIEQGDV

SEQ ID NO: 15569 - protein, 19 aa, Brucella spp.
RPELITRTFEALEGAKTPI

SEQ ID NO: 15570 - protein, 17 aa, Brucella spp.
GGGYRFQYSPESFTGTE

SEQ ID NO: 15571 - protein, 18 aa, Brucella spp.
HPYVGELVYTAFSGSHQD

SEQ ID NO: 15572 - protein, 20 aa, Brucella spp.
YGLNLPRNLQVEFREIIQHI

SEQ ID NO: 15573 - protein, 23 aa, Brucella spp.
EMVYPGGKLFGVGINDNIVSASL

SEQ ID NO: 15574 - protein, 20 aa, Brucella spp.
FRYLKGPIFAQLLMADEINR

SEQ ID NO: 15575 - protein, 20 aa, Brucella spp.
QRYDLPAPFHVLATQNPLEQ

SEQ ID NO: 15576 - protein, 26 aa, Brucella spp.
TYPLPEAQLDRFLMQIDILYPELAAE

SEQ ID NO: 15577 - protein, 17 aa, Brucella spp.
LMQIDILYPELAAERRI

SEQ ID NO: 15578 - protein, 18 aa, Brucella spp.
VLQHRMALNFAARADGMH

SEQ ID NO: 15579 - protein, 21 aa, Brucella spp.
RPHELVVYGGIGRAARTWDDF

SEQ ID NO: 15580 - protein, 21 aa, Brucella spp.
GGNLKGRWILTGGLGGMGGAQ

SEQ ID NO: 15581 - protein, 18 aa, Brucella spp.
AEIFPELVKRGVKPDIVT

SEQ ID NO: 15582 - protein, 23 aa, Brucella spp.
DPVHGYLPLGWTVAEWRAKQEND

SEQ ID NO: 15583 - protein, 19 aa, Brucella spp.
VQVQAMLDFWNAGIPTVDY

SEQ ID NO: 15584 - protein, 44 aa, Brucella spp.
MALEEGLENAFAFPGFVPAYIRPLFCRGIGPFRWAALSGDPEDI

SEQ ID NO: 15585 - protein, 28 aa, Brucella spp.
KERIAFQGLPARICWVGLGDRHRLGLAF

SEQ ID NO: 15586 - protein, 21 aa, Brucella spp.
NGELKAPIVIGRDHLDSGSVA

SEQ ID NO: 15587 - protein, 22 aa, Brucella spp.
DAVSDWPLLNALLNTASGATWV

SEQ ID NO: 15588 - protein, 18 aa, Brucella spp.
SLHHGGGVGMGFSQHAGM

SEQ ID NO: 15589 - protein, 25 aa, Brucella spp.
HADAGYDIALDWARKQGLRLPAILG

SEQ ID NO: 15590 - protein, 23 aa, Brucella spp.
MEIKADGTWFYMGTPIGRKQLVR

SEQ ID NO: 15591 - protein, 18 aa, Brucella spp.
RKQLVRLFSTVLRKDEDG

SEQ ID NO: 15592 - protein, 18 aa, Brucella spp.
GADHPLRFAVEPESGGLK

SEQ ID NO: 15593 - protein, 21 aa, Brucella spp.
GRLEALVARSVMYDLVALGEE

SEQ ID NO: 15594 - protein, 24 aa, Brucella spp.
EEIEIDGVMTFAVRSGGAVFPVMP

SEQ ID NO: 15595 - protein, 17 aa, Brucella spp.
GAVFPVMPSAMLEAALQ

SEQ ID NO: 15596 - protein, 25 aa, Brucella spp.
EVADIFEVPLSFLMNPANHRRESRL

SEQ ID NO: 15597 - protein, 27 aa, Brucella spp.
ERFYYAMPYHERFIWGATAGIIRGLYE

SEQ ID NO: 15598 - protein, 27 aa, Brucella spp.
REDYLRILRFFRFFAWYGSGRPEAEGL

SEQ ID NO: 15599 - protein, 23 aa, Brucella spp.
GAPDPSRALLWMRQAGVLNLVLP

SEQ ID NO: 15600 - protein, 26 aa, Brucella spp.
LPESEKWGIDAIHGLVRTQSDLGWQA

SEQ ID NO: 15601 - protein, 19 aa, Brucella spp.
ALLDRIRLAYAAARQEAVG

SEQ ID NO: 15602 - protein, 22 aa, Brucella spp.
VVGVGGLAWPFIDQMRPDASTL

SEQ ID NO: 15603 - protein, 18 aa, Brucella spp.
SLTVKWRGKPVFIRNRTA

SEQ ID NO: 15604 - protein, 20 aa, Brucella spp.
GEGKENWLVMIGVCTHLGCV

SEQ ID NO: 15605 - protein, 23 aa, Brucella spp.
CVPLGESGAFGGWFCPCHGSTYD

SEQ ID NO: 15606 - protein, 17 aa, Brucella spp.
LPLPRLVYDSFVAYPTP

SEQ ID NO: 15607 - protein, 17 aa, Brucella spp.
IMRDVNSGWLLRYMHAN

SEQ ID NO: 15608 - protein, 18 aa, Brucella spp.
VNSGWLLRYMHANGASFF

SEQ ID NO: 15609 - protein, 25 aa, Brucella spp.
YKAPRELLWILGVVIFLLMMATAFM

SEQ ID NO: 15610 - protein, 22 aa, Brucella spp.
RFFSLHYLLPFMIAGVVILHVW

SEQ ID NO: 15611 - protein, 23 aa, Brucella spp.
IKDAFGALVFFVFFAYFIFYLPN

SEQ ID NO: 15612 - protein, 23 aa, Brucella spp.
IVPEWYFLPFYAMLRAITFNIGP

SEQ ID NO: 15613 - protein, 26 aa, Brucella spp.
VYRPWFKLFFWLFVINAIFLGWLGSR

SEQ ID NO: 15614 - protein, 17 aa, Brucella spp.
GTLYYFAFFLIIMPVVG

SEQ ID NO: 15615 - protein, 21 aa, Brucella spp.
HPKQESWSFAGPFGTYDKGQL

SEQ ID NO: 15616 - protein, 21 aa, Brucella spp.
CSACHSMNLVAFRTLEGLGYS

SEQ ID NO: 15617 - protein, 17 aa, Brucella spp.
MNLVAFRTLEGLGYSPE

SEQ ID NO: 15618 - protein, 25 aa, Brucella spp.
RSVERGFPQFIFDIFTQYAEGGPDY

SEQ ID NO: 15619 - protein, 24 aa, Brucella spp.
QYARDVSAFLMWAAEPHLEDRKKT

SEQ ID NO: 15620 - protein, 27 aa, Brucella spp.
RKKTGFRVIVFLVLFAGLVYIAKRSIW

SEQ ID NO: 15621 - protein, 23 aa, Brucella spp.
QMGAEIVAACFIIDLPDLGGRKK

SEQ ID NO: 15622 - protein, 21 aa, Brucella spp.
IPTRINFVDIAGLVRGASKGE

SEQ ID NO: 15623 - protein, 17 aa, Brucella spp.
GLGNQFLANIREVDAIV

SEQ ID NO: 15624 - protein, 23 aa, Brucella spp.
KDKEALAILPVMEKALELLQNGQ

SEQ ID NO: 15625 - protein, 20 aa, Brucella spp.
EPGLDRLIRAGYKLLDLITY

SEQ ID NO: 15626 - protein, 25 aa, Brucella spp.
IRAGYKLLDLITYFTAGPKETRAWT

SEQ ID NO: 15627 - protein, 17 aa, Brucella spp.
SGQSIGEAMRFYKLTPA

SEQ ID NO: 15628 - protein, 24 aa, Brucella spp.
QSIGEAMRFYKLTPADLVVIYDEL

SEQ ID NO: 15629 - protein, 20 aa, Brucella spp.
PGAKELVHNYVLGDFAKADN

SEQ ID NO: 15630 - protein, 18 aa, Brucella spp.
LVHNYVLGDFAKADNEWL

SEQ ID NO: 15631 - protein, 24 aa, Brucella spp.
PLAIAVSYKEIFYKIHGGGFKTTV

SEQ ID NO: 15632 - protein, 25 aa, Brucella spp.
DPVRDFPQHVDFLRVSAKSVVHVNV

SEQ ID NO: 15633 - protein, 18 aa, Brucella spp.
APGIKRGGVLNVVRHDVE

SEQ ID NO: 15634 - protein, 18 aa, Brucella spp.
LDLEELLATRLLVQGNSG

SEQ ID NO: 15635 - protein, 17 aa, Brucella spp.
MRSAAAFLGGLFDAERD

SEQ ID NO: 15636 - protein, 23 aa, Brucella spp.
EPVEAPLFPGIVEAEREELLEKV

SEQ ID NO: 15637 - protein, 20 aa, Brucella spp.
VLYQDFLVRCRIHRVPGEPL

SEQ ID NO: 15638 - protein, 17 aa, Brucella spp.
FLVRCRIHRVPGEPLAL

SEQ ID NO: 15639 - protein, 25 aa, Brucella spp.
RVPGEPLALPAFRRRLAVAQASIES

SEQ ID NO: 15640 - protein, 17 aa, Brucella spp.
VQGVFLIVAQAAVTGAP

SEQ ID NO: 15641 - protein, 17 aa, Brucella spp.
RARRLLAYFEERGLLVV

SEQ ID NO: 15642 - protein, 23 aa, Brucella spp.
RNDFKGMRIVNFPDLGCETAPGD

SEQ ID NO: 15643 - protein, 25 aa, Brucella spp.
ANDHLMELLIMIDAFRRSSARRITA

SEQ ID NO: 15644 - protein, 25 aa, Brucella spp.
SARRITAVLPYFGYARQDRKPGPRT

SEQ ID NO: 15645 - protein, 23 aa, Brucella spp.
LDLHAGQIQGFFDIPTDNLYAVP

SEQ ID NO: 15646 - protein, 20 aa, Brucella spp.
IPTDNLYAVPVIARDVKANY

SEQ ID NO: 15647 - protein, 25 aa, Brucella spp.
KMEEEKLDALLLFAQESMYWLTGYD

SEQ ID NO: 15648 - protein, 28 aa, Brucella spp.
MYWLTGYDTFGFCFFQCLVVKADGSMVL

SEQ ID NO: 15649 - protein, 20 aa, Brucella spp.
NDQLTLEWSGVFRHYHAPMM

SEQ ID NO: 15650 - protein, 22 aa, Brucella spp.
HYHAPMMCTLIIGKPTKHHMEL

SEQ ID NO: 15651 - protein, 19 aa, Brucella spp.
FTPSWMDPQMFYAANPESI

SEQ ID NO: 15652 - protein, 18 aa, Brucella spp.
KRITHGFFTRKGGVSDGI

SEQ ID NO: 15653 - protein, 23 aa, Brucella spp.
NYEVGPEFYAEFIGKDPNYAAYF

SEQ ID NO: 15654 - protein, 24 aa, Brucella spp.
EKPEHYLFDLWTFITDRLTKAGVQ

SEQ ID NO: 15655 - protein, 33 aa, Brucella spp.
VSQMFGELIGIWCLSEWDALARPANFVLCEIGP

SEQ ID NO: 15656 - protein, 26 aa, Brucella spp.
LVTNELFDAIPFRQFVKADGRFVERM

SEQ ID NO: 15657 - protein, 24 aa, Brucella spp.
MTQGEFLLAMGLVDRAGRLGAGKD

SEQ ID NO: 15658 - protein, 24 aa, Brucella spp.
AFLEGLVLFFVLFVLVWGARKLKQ

SEQ ID NO: 15659 - protein, 17 aa, Brucella spp.
AQIGYLFGGWLTMGMVL

SEQ ID NO: 15660 - protein, 20 aa, Brucella spp.
SVPMVLLGLWAMWRANRAAA

SEQ ID NO: 15661 - protein, 20 aa, Brucella spp.
REDFEALREMAIKARSEKSA

SEQ ID NO: 15662 - protein, 20 aa, Brucella spp.
KARSEKSALLARIEALEARL

SEQ ID NO: 15663 - protein, 21 aa, Brucella spp.
AYKLKIDFGEKIGIKKSSAQI

SEQ ID NO: 15664 - protein, 17 aa, Brucella spp.
VLLQSVIAYVFMERHWQ

SEQ ID NO: 15665 - protein, 23 aa, Brucella spp.
LPPPGPKPFFAILDYFLSEEITR

SEQ ID NO: 15666 - protein, 17 aa, Brucella spp.
FAILDYFLSEEITRQIN

SEQ ID NO: 15667 - protein, 23 aa, Brucella spp.
RIKLEDKVLRVFARRSQAYASNT

SEQ ID NO: 15668 - protein, 19 aa, Brucella spp.
TGIFLTWMVGTALVLLIIA

SEQ ID NO: 15669 - protein, 20 aa, Brucella spp.
EVRRAGLAFIQMRSRIERQI

SEQ ID NO: 15670 - protein, 25 aa, Brucella spp.
RTILTRFKLQLALAGHSIDTEPLNQ

SEQ ID NO: 15671 - protein, 17 aa, Brucella spp.
RGFKYTIEGDREINVRP

SEQ ID NO: 15672 - protein, 25 aa, Brucella spp.
RRKLEGIDFDLLILDVMMPGETGVS

SEQ ID NO: 15673 - protein, 19 aa, Brucella spp.
PGETGVSLTRSLREQKNVP

SEQ ID NO: 15674 - protein, 18 aa, Brucella spp.
QKNVPILMLTALSETDSR

SEQ ID NO: 15675 - protein, 24 aa, Brucella spp.
PKIEQIVFGPYTFFIPRRELKKGT

SEQ ID NO: 15676 - protein, 27 aa, Brucella spp.
ATDLNVIELLFFSYRDFTADPDLILEK

SEQ ID NO: 15677 - protein, 18 aa, Brucella spp.
ADPDLILEKIGFGRAHHR

SEQ ID NO: 15678 - protein, 18 aa, Brucella spp.
LILEKIGFGRAHHRVLYF

SEQ ID NO: 15679 - protein, 22 aa, Brucella spp.
FGRAHHRVLYFINRKPGMTVAE

SEQ ID NO: 15680 - protein, 24 aa, Brucella spp.
PGMTVAELLEVLRITKQSLSRVLK

SEQ ID NO: 15681 - protein, 21 aa, Brucella spp.
PLFKHGELWTPHRPARPEKSE

SEQ ID NO: 15682 - protein, 23 aa, Brucella spp.
SEGGIPIRMETSFEPSGDQPTAI

SEQ ID NO: 15683 - protein, 30 aa, Brucella spp.
AQLYGEFKSFFPNNAVEYFVSYYDYYQPEA

SEQ ID NO: 15684 - protein, 28 aa, Brucella spp.
GIGSVETYTAMTFEMKIGDRLDQRQLLA

SEQ ID NO: 15685 - protein, 23 aa, Brucella spp.
FPAHLEDRAWRISLFGDEIETIT

SEQ ID NO: 15686 - protein, 17 aa, Brucella spp.
PGEPPPTLFEYIPDNAL

SEQ ID NO: 15687 - protein, 27 aa, Brucella spp.
PPPTLFEYIPDNALVFIDESHVTVPQI

SEQ ID NO: 15688 - protein, 17 aa, Brucella spp.
VPQIGGMYRGDFRRKAT

SEQ ID NO: 15689 - protein, 30 aa, Brucella spp.
FRRKATLAEYGFRLPSCMDNRPLRFEEWDA

SEQ ID NO: 15690 - protein, 17 aa, Brucella spp.
MDNRPLRFEEWDAMRPQ

SEQ ID NO: 15691 - protein, 17 aa, Brucella spp.
EAGGVFAEQVIRPTGLI

SEQ ID NO: 15692 - protein, 34 aa, Brucella spp.
ERIEIIRDLRLGAFDVLVGINLLREGLDIPECGF

SEQ ID NO: 15693 - protein, 25 aa, Brucella spp.
GLDIPECGFVAILDADKEGFLRSET

SEQ ID NO: 15694 - protein, 22 aa, Brucella spp.
FLRSETSLIQTIGRAARNVDGK

SEQ ID NO: 15695 - protein, 18 aa, Brucella spp.
AAADLDFEKAARLRDEIK

SEQ ID NO: 15696 - protein, 17 aa, Brucella spp.
TEIPAGGKAPIRRERAG

SEQ ID NO: 15697 - protein, 20 aa, Brucella spp.
KDANSAYDIFGGWVMAQMDM

SEQ ID NO: 15698 - protein, 25 aa, Brucella spp.
AAVREMAFARPVKIGDTLCVYTDIT

SEQ ID NO: 15699 - protein, 31 aa, Brucella spp.
ACIGHARFLSRHLTPILLLALLAGCSGERAP

SEQ ID NO: 15700 - protein, 18 aa, Brucella spp.
CRTRLKRLGVVFKEKPPI

SEQ ID NO: 15701 - protein, 17 aa, Brucella spp.
VTEALARWIKGDLQPAA

SEQ ID NO: 15702 - protein, 22 aa, Brucella spp.
WIKGDLQPAARLRYLSGVNTIY

SEQ ID NO: 15703 - protein, 22 aa, Brucella spp.
NIMVRKPGFFAFREKGLLNTVR

SEQ ID NO: 15704 - protein, 19 aa, Brucella spp.
CSYFTTVLGPGYNPEHADH

SEQ ID NO: 15705 - protein, 18 aa, Brucella spp.
PRIIEAIAEARAHGDLSE

SEQ ID NO: 15706 - protein, 17 aa, Brucella spp.
DVSKLTGDRIKFGATVT

SEQ ID NO: 15707 - protein, 22 aa, Brucella spp.
LTGDRIKFGATVTMIDEDTEEE

SEQ ID NO: 15708 - protein, 17 aa, Brucella spp.
FGATVTMIDEDTEEEKI

SEQ ID NO: 15709 - protein, 24 aa, Brucella spp.
KEGRISISSPIARALIGKGEGDTI

SEQ ID NO: 15710 - protein, 19 aa, Brucella spp.
KPRLLLAKLGKPFRHVTVS

SEQ ID NO: 15711 - protein, 25 aa, Brucella spp.
VDPYERALVYQWLFFEQYSHEPYIA

SEQ ID NO: 15712 - protein, 17 aa, Brucella spp.
NLMFKLKLREGLARDLI

SEQ ID NO: 15713 - protein, 20 aa, Brucella spp.
LKLREGLARDLIGQWLEPGR

SEQ ID NO: 15714 - protein, 17 aa, Brucella spp.
PGRAFRLANAGEIGINP

SEQ ID NO: 15715 - protein, 18 aa, Brucella spp.
TVILISFIGVLWSLSSGF

SEQ ID NO: 15716 - protein, 25 aa, Brucella spp.
IGVLWSLSSGFVFHIAGYSFSIPGY

SEQ ID NO: 15717 - protein, 25 aa, Brucella spp.
GYSFSIPGYMVWAVIIYAASASWLT

SEQ ID NO: 15718 - protein, 30 aa, Brucella spp.
QRTLLFRALGGLWPWGEGRIGMPVGEAVAF

SEQ ID NO: 15719 - protein, 26 aa, Brucella spp.
EGRIGMPVGEAVAFMPRAPYFPPGNL

SEQ ID NO: 15720 - protein, 17 aa, Brucella spp.
ERQCLAFARLILQQPKW

SEQ ID NO: 15721 - protein, 19 aa, Brucella spp.
LAFARLILQQPKWIVIDGA

SEQ ID NO: 15722 - protein, 20 aa, Brucella spp.
LKEEGYRIILVNSNPATIMT

SEQ ID NO: 15723 - protein, 25 aa, Brucella spp.
LDVVGLPAIIRPSFTLGGTGGGIAY

SEQ ID NO: 15724 - protein, 18 aa, Brucella spp.
VLIEESVLGWKEYEMEVV

SEQ ID NO: 15725 - protein, 17 aa, Brucella spp.
VLGWKEYEMEVVRDHAD

SEQ ID NO: 15726 - protein, 18 aa, Brucella spp.
PASFEPSIDYVVTKIPRF

SEQ ID NO: 15727 - protein, 29 aa, Brucella spp.
PSIDYVVTKIPRFAFEKFPGSSPILTTAM

SEQ ID NO: 15728 - protein, 21 aa, Brucella spp.
KSVGEVMAIGRTFQESLQKAL

SEQ ID NO: 15729 - protein, 19 aa, Brucella spp.
ASKIDPWFLEQIESIVKTE

SEQ ID NO: 15730 - protein, 22 aa, Brucella spp.
ENLRMLKAMGFSDARLASLTAK

SEQ ID NO: 15731 - protein, 25 aa, Brucella spp.
IDTCAAEFASPTAYMYSTYETPFVG

SEQ ID NO: 15732 - protein, 30 aa, Brucella spp.
GPNRIGQGIEFDYCCCHAAFALGDADYEAI

SEQ ID NO: 15733 - protein, 17 aa, Brucella spp.
VIVQFGGQTPLKLANAL

SEQ ID NO: 15734 - protein, 33 aa, Brucella spp.
VEQARLVAADLGFPLVVRPSYVLGGRAMQIIHD

SEQ ID NO: 15735 - protein, 17 aa, Brucella spp.
DSACLLPVHTLSPEIVA

SEQ ID NO: 15736 - protein, 17 aa, Brucella spp.
ACLLPVHTLSPEIVAEL

SEQ ID NO: 15737 - protein, 18 aa, Brucella spp.
ALHVGGLMNVQFAIKDGE

SEQ ID NO: 15738 - protein, 17 aa, Brucella spp.
VGGLMNVQFAIKDGEIF

SEQ ID NO: 15739 - protein, 19 aa, Brucella spp.
IKDGEIFILEVNPRASRTV

SEQ ID NO: 15740 - protein, 31 aa, Brucella spp.
IAVKEAVFPFARFPGVDTLLGPEMRSTGEVM

SEQ ID NO: 15741 - protein, 25 aa, Brucella spp.
EVMGLDYDYALAFAKAQLGAGVELP

SEQ ID NO: 15742 - protein, 24 aa, Brucella spp.
GVELPREGTVFVSVRDEDKERVLG

SEQ ID NO: 15743 - protein, 23 aa, Brucella spp.
GPVRKLASIGFKVMATGGTQKFL

SEQ ID NO: 15744 - protein, 17 aa, Brucella spp.
VEAEVVFNTALTGYEEI

SEQ ID NO: 15745 - protein, 19 aa, Brucella spp.
IFKADITAPSNFRAAKDLD

SEQ ID NO: 15746 - protein, 25 aa, Brucella spp.
DSWLKHRGIIALAGIDTRALTALIR

SEQ ID NO: 15747 - protein, 24 aa, Brucella spp.
LAKDVTIGQSLVWKELPWTLQDGY

SEQ ID NO: 15748 - protein, 19 aa, Brucella spp.
VWKELPWTLQDGYGEQDAP

SEQ ID NO: 15749 - protein, 29 aa, Brucella spp.
QYHVVALDFGVKRNILRLLTGLGAKVTVL

SEQ ID NO: 15750 - protein, 28 aa, Brucella spp.
ETGIPLFGICLGHQMLALALGGRTEKMH

SEQ ID NO: 15751 - protein, 20 aa, Brucella spp.
DSHYLFRRFINLIRERKGQA

SEQ ID NO: 15752 - protein, 20 aa, Brucella spp.
GDEELLGILGKMVKQREESA

SEQ ID NO: 15753 - protein, 22 aa, Brucella spp.
EREEIAIISEFLPQQMTEDETK

SEQ ID NO: 15754 - protein, 22 aa, Brucella spp.
KERYAGKMDFTRASALVKSLLQ

SEQ ID NO: 15755 - protein, 18 aa, Brucella spp.
VPISTLIGTRVSFDRKKS

SEQ ID NO: 15756 - protein, 23 aa, Brucella spp.
NPPKGDFWACCPFHGEKTPSFHC

SEQ ID NO: 15757 - protein, 24 aa, Brucella spp.
GDHFKFLTDLEGLSFPEAVERVAD

SEQ ID NO: 15758 - protein, 25 aa, Brucella spp.
DRVMFPIEDLRGRIIAFGGRALSAD

SEQ ID NO: 15759 - protein, 30 aa, Brucella spp.
TEEQLELLWRISPEPILCFDGDGAGLRAAY

SEQ ID NO: 15760 - protein, 18 aa, Brucella spp.
AEGPSAFHAVLRDARPLV

SEQ ID NO: 15761 - protein, 23 aa, Brucella spp.
APLRETAIVLTLLNHPRLIEEDF

SEQ ID NO: 15762 - protein, 19 aa, Brucella spp.
LIEEDFETLAALDLGHDAL

SEQ ID NO: 15763 - protein, 20 aa, Brucella spp.
TLHLAMLDVLAAGRVDDGIA

SEQ ID NO: 15764 - protein, 24 aa, Brucella spp.
MYLREMGSVELLSREGEIAIAKRI

SEQ ID NO: 15765 - protein, 20 aa, Brucella spp.
SREGEIAIAKRIEAGRETMI

SEQ ID NO: 15766 - protein, 26 aa, Brucella spp.
LCESPLSFQAIIIWRDQLNESNILLR

SEQ ID NO: 15767 - protein, 23 aa, Brucella spp.
AELRPQVMETLDFIADTYKKLRK

SEQ ID NO: 15768 - protein, 24 aa, Brucella spp.
VQNEGKLLRLAESFGVRREDFLKE

SEQ ID NO: 15769 - protein, 18 aa, Brucella spp.
HELDPNWVERVATLPSRG

SEQ ID NO: 15770 - protein, 27 aa, Brucella spp.
WVERVATLPSRGWKEFAAKEADSIGRL

SEQ ID NO: 15771 - protein, 21 aa, Brucella spp.
EANLRLVISIAKKYTNRGLQF

SEQ ID NO: 15772 - protein, 18 aa, Brucella spp.
YTNRGLQFLDLIQEGNIG

SEQ ID NO: 15773 - protein, 18 aa, Brucella spp.
LQFLDLIQEGNIGLMKAV

SEQ ID NO: 15774 - protein, 32 aa, Brucella spp.
AVDKFEYRRGYKFSTYATWWIRQAITRSIADQ

SEQ ID NO: 15775 - protein, 23 aa, Brucella spp.
QARTIRIPVHMIETINKIVRTSR

SEQ ID NO: 15776 - protein, 24 aa, Brucella spp.
REERVLRMRFGIGMNTDHTLEEVG

SEQ ID NO: 15777 - protein, 22 aa, Brucella spp.
AGRLEHKDFLIIATPYSEGGQY

SEQ ID NO: 15778 - protein, 17 aa, Brucella spp.
IEDAASIALNKGRQIID

SEQ ID NO: 15779 - protein, 17 aa, Brucella spp.
DAASIALNKGRQIIDEQ

SEQ ID NO: 15780 - protein, 19 aa, Brucella spp.
FVVTAAIGVAAMFSASASA

SEQ ID NO: 15781 - protein, 25 aa, Brucella spp.
SELSRPPMPMPIARGQFRTMLAAAP

SEQ ID NO: 15782 - protein, 18 aa, Brucella spp.
IARGQFRTMLAAAPDNSV

SEQ ID NO: 15783 - protein, 17 aa, Brucella spp.
TFADLSVLKTWYGTKTP

SEQ ID NO: 15784 - protein, 18 aa, Brucella spp.
AAPGLAFTKPLAASINGK

SEQ ID NO: 15785 - protein, 24 aa, Brucella spp.
LHSPCWSALLLTMIAQVKTKGLSG

SEQ ID NO: 15786 - protein, 22 aa, Brucella spp.
DEEGFKFRPDLGISVQGQSASD

SEQ ID NO: 15787 - protein, 27 aa, Brucella spp.
RLSKKWAIPVSVKFWWKQNPKAQYPGK

SEQ ID NO: 15788 - protein, 20 aa, Brucella spp.
VAGLVWPAMVDQLRMNEVIM

SEQ ID NO: 15789 - protein, 20 aa, Brucella spp.
EKGLAGGLLYFPEYAKYQDP

SEQ ID NO: 15790 - protein, 25 aa, Brucella spp.
EDSLAPWDFLTWALANFSTVAEVKD

SEQ ID NO: 15791 - protein, 18 aa, Brucella spp.
QNMFEYTQWTAFADMKND

SEQ ID NO: 15792 - protein, 19 aa, Brucella spp.
KTYDDQVLRSFSFKDFDVD

SEQ ID NO: 15793 - protein, 32 aa, Brucella spp.
QAGYDITAIELVELIGKKPWLLETLITNASQK

SEQ ID NO: 15794 - protein, 17 aa, Brucella spp.
AVFGMRIVFPLGIVAIA

SEQ ID NO: 15795 - protein, 19 aa, Brucella spp.
RIVFPLGIVAIAMWTDPIS

SEQ ID NO: 15796 - protein, 24 aa, Brucella spp.
VQGVEIGVAIALIIFFSYQLDADH

SEQ ID NO: 15797 - protein, 23 aa, Brucella spp.
RYLEHGAFYAILVLAIIMYVQTL

SEQ ID NO: 15798 - protein, 19 aa, Brucella spp.
NDFCPGGALAVERGDEIIP

SEQ ID NO: 15799 - protein, 22 aa, Brucella spp.
GAEFHPDLQWWRAQLVVRKGFR

SEQ ID NO: 15800 - protein, 24 aa, Brucella spp.
DRARLELLAPDFLQREIFCCGPEP

SEQ ID NO: 15801 - protein, 18 aa, Brucella spp.
IAEGYILACCSRPRGRVE

SEQ ID NO: 15802 - protein, 24 aa, Brucella spp.
YKLDLENIFYKDWLFVGHDCELPK

SEQ ID NO: 15803 - protein, 25 aa, Brucella spp.
WTYELDGRLLFARQVGPDFKPADYG

SEQ ID NO: 15804 - protein, 21 aa, Brucella spp.
IIEKGNWKLVWENNRECYHCA

SEQ ID NO: 15805 - protein, 29 aa, Brucella spp.
INQLWKSCASIGLPARFNISEDGRYRITR

SEQ ID NO: 15806 - protein, 18 aa, Brucella spp.
ITRIPLLRDAVSYTMSGK

SEQ ID NO: 15807 - protein, 19 aa, Brucella spp.
IGAMLLFNYPSTWNHLMAD

SEQ ID NO: 15808 - protein, 17 aa, Brucella spp.
DHAISFRVLPISAEETL

SEQ ID NO: 15809 - protein, 18 aa, Brucella spp.
EHEGGVMQFLEWYTNTMT

SEQ ID NO: 15810 - protein, 19 aa, Brucella spp.
GGVMQFLEWYTNTMTPRLR

SEQ ID NO: 15811 - protein, 24 aa, Brucella spp.
VPSGILPRLTFRAWGRSIKGHRTL

SEQ ID NO: 15812 - protein, 18 aa, Brucella spp.
SIKGHRTLFDWLSHDPAE

SEQ ID NO: 15813 - protein, 25 aa, Brucella spp.
LCGFDASVALWIDIFHMIRRGANNR

SEQ ID NO: 15814 - protein, 22 aa, Brucella spp.
SIPKHLPFHLIGGAEDPATAGG

SEQ ID NO: 15815 - protein, 17 aa, Brucella spp.
PDVEFFISDAASFEPDA

SEQ ID NO: 15816 - protein, 24 aa, Brucella spp.
DAIVEWVKGTGLRPFLDPLDEQEQ

SEQ ID NO: 15817 - protein, 22 aa, Brucella spp.
GFLMRPIGGWLFGRIADKLGRR

SEQ ID NO: 15818 - protein, 24 aa, Brucella spp.
PTYETIGVLAPFLLLVVRLVQGLS

SEQ ID NO: 15819 - protein, 31 aa, Brucella spp.
LTSEQLHSWGWRIPFAIGGLAAIVALYLRRT

SEQ ID NO: 15820 - protein, 20 aa, Brucella spp.
SETMTFVLLVFMLMQPLFGA

SEQ ID NO: 15821 - protein, 21 aa, Brucella spp.
FPAEVRALGVGFSYAIANALF

SEQ ID NO: 15822 - protein, 25 aa, Brucella spp.
KKQGMESGFFWYVTAIMVVVFIVSL

SEQ ID NO: 15823 - protein, 22 aa, Brucella spp.
DSEPIRAAALAPHMKTLPPSTA

SEQ ID NO: 15824 - protein, 17 aa, Brucella spp.
KDSARFFVLNAINAKLT

SEQ ID NO: 15825 - protein, 18 aa, Brucella spp.
AKLTEWRATRLLSPEDDE

SEQ ID NO: 15826 - protein, 23 aa, Brucella spp.
AVAEPSRLRILALLARGDLTVSD

SEQ ID NO: 15827 - protein, 26 aa, Brucella spp.
TGRLLELFAPLYLRGVGIDINRDMLA

SEQ ID NO: 15828 - protein, 17 aa, Brucella spp.
FDLVTIHQVLHFLDDPL

SEQ ID NO: 15829 - protein, 18 aa, Brucella spp.
DEQMLGWMRDAGLEPEKT

SEQ ID NO: 15830 - protein, 23 aa, Brucella spp.
GEEGLTVKLWLARDPRLLIADPV

SEQ ID NO: 15831 - protein, 17 aa, Brucella spp.
VTRLAPLQPDFVSVTYG

SEQ ID NO: 15832 - protein, 21 aa, Brucella spp.
VRRAGIYIPIVPGVLPVHNFK

SEQ ID NO: 15833 - protein, 17 aa, Brucella spp.
LPVHNFKQVRNFCARSA

SEQ ID NO: 15834 - protein, 19 aa, Brucella spp.
SATHIPAWLAERFDGLDND

SEQ ID NO: 15835 - protein, 25 aa, Brucella spp.
CRDAYPRFLAWPLWLLAELAICATD

SEQ ID NO: 15836 - protein, 28 aa, Brucella spp.
GLNLLFGIPLEIGVILTAVDVLLVLYLQ

SEQ ID NO: 15837 - protein, 19 aa, Brucella spp.
ALIITLLGVIALCFLTQII

SEQ ID NO: 15838 - protein, 19 aa, Brucella spp.
FIDIRLKPWIRRAITRFVA

SEQ ID NO: 15839 - protein, 20 aa, Brucella spp.
SLQLPFAVIPLVIFTAQKKK

SEQ ID NO: 15840 - protein, 24 aa, Brucella spp.
EVRHVPVLIAEVIDALKPAPGAVI

SEQ ID NO: 15841 - protein, 24 aa, Brucella spp.
AMEKEFPGRLNLVESRFSALDEAV

SEQ ID NO: 15842 - protein, 25 aa, Brucella spp.
RLKTGDLARIFNFLGEERHAGRIAR

SEQ ID NO: 15843 - protein, 19 aa, Brucella spp.
GEERHAGRIARMIEKRRAA

SEQ ID NO: 15844 - protein, 18 aa, Brucella spp.
ELARALLAAERILKPGGR

SEQ ID NO: 15845 - protein, 18 aa, Brucella spp.
ILKPGGRLVVVTFHSLED

SEQ ID NO: 15846 - protein, 21 aa, Brucella spp.
PLEDDLSLFGLPKLPETNELA

SEQ ID NO: 15847 - protein, 19 aa, Brucella spp.
AEKQIAVIAKLKRQIDSEK

SEQ ID NO: 15848 - protein, 20 aa, Brucella spp.
EKDTITLLRADWALMTQPGR

SEQ ID NO: 15849 - protein, 17 aa, Brucella spp.
MTQPGRLQSLVGVYETE

SEQ ID NO: 15850 - protein, 18 aa, Brucella spp.
LAGNMAFVGSRKRHGNRA

SEQ ID NO: 15851 - protein, 29 aa, Brucella spp.
RNRLWMAIACFAGIYGVMAGKLVYFGMIG

SEQ ID NO: 15852 - protein, 20 aa, Brucella spp.
VMAGKLVYFGMIGGVDQDAA

SEQ ID NO: 15853 - protein, 25 aa, Brucella spp.
TYKRLKSGAGFVWIKRGLTPKQQSQ

SEQ ID NO: 15854 - protein, 19 aa, Brucella spp.
TGEVIAMSSVPDFDPNNPV

SEQ ID NO: 15855 - protein, 24 aa, Brucella spp.
QSKLDASRPLVFGRQTIRDFHGKG

SEQ ID NO: 15856 - protein, 26 aa, Brucella spp.
GKGRWLTLPEVFIFSSNIGSGREADA

SEQ ID NO: 15857 - protein, 24 aa, Brucella spp.
VGIEGHRAFLKKIGLLDRMQTELP

SEQ ID NO: 15858 - protein, 23 aa, Brucella spp.
RVWKKVHSMTISFGHGMMATPLQ

SEQ ID NO: 15859 - protein, 20 aa, Brucella spp.
SADMRYLYRLNSTAPGGSGR

SEQ ID NO: 15860 - protein, 18 aa, Brucella spp.
VRFNAFLASFPMDNPTYV

SEQ ID NO: 15861 - protein, 17 aa, Brucella spp.
MDNPTYVVLTIIDEPKP

SEQ ID NO: 15862 - protein, 24 aa, Brucella spp.
DSRAVQRGFLFAALKGVKADGAVF

SEQ ID NO: 15863 - protein, 20 aa, Brucella spp.
PRHVLAIAAAQFYGKQPEVM

SEQ ID NO: 15864 - protein, 24 aa, Brucella spp.
ASFTRQIWAYAGFPAANIGTTGVF

SEQ ID NO: 15865 - protein, 21 aa, Brucella spp.
LGAKMRLFNALLPKGAPAIIF

SEQ ID NO: 15866 - protein, 20 aa, Brucella spp.
FNALLPKGAPAIIFADDQFS

SEQ ID NO: 15867 - protein, 25 aa, Brucella spp.
EIFEIELPLAGDFQVANALVAAGLA

SEQ ID NO: 15868 - protein, 22 aa, Brucella spp.
TSVRPFTTGRVIVVFGCGGDRD

SEQ ID NO: 15869 - protein, 22 aa, Brucella spp.
RTLKPGEAFFAIKGEQFDGHDF

SEQ ID NO: 15870 - protein, 20 aa, Brucella spp.
LEALIRLGIAARARSKAQII

SEQ ID NO: 15871 - protein, 26 aa, Brucella spp.
ASFNNHWGVPLTLARMPADVDYGVFE

SEQ ID NO: 15872 - protein, 21 aa, Brucella spp.
RMPADVDYGVFEIGMNHHGEI

SEQ ID NO: 15873 - protein, 25 aa, Brucella spp.
KMVRPHVALITLIAPAHLGHFANLE

SEQ ID NO: 15874 - protein, 25 aa, Brucella spp.
EHVTPFNVFRYITFRTGGAMITSAL

SEQ ID NO: 15875 - protein, 19 aa, Brucella spp.
LGIEFLIAAIAAFTIMRAG

SEQ ID NO: 15876 - protein, 26 aa, Brucella spp.
SSLTFPFVKQLVINLSWFFIPFAAFV

SEQ ID NO: 15877 - protein, 21 aa, Brucella spp.
INLSWFFIPFAAFVMVGAGNA

SEQ ID NO: 15878 - protein, 23 aa, Brucella spp.
TESQVVIRFWIVAIILAMIGLST

SEQ ID NO: 15879 - protein, 25 aa, Brucella spp.
LRQADWSQFAVFVLSPGVPLTHPQP

SEQ ID NO: 15880 - protein, 24 aa, Brucella spp.
LTLELPCADRFYVVECSSYQIDLA

SEQ ID NO: 15881 - protein, 23 aa, Brucella spp.
RGYFADGAKLLWAQDGEIDEIAS

SEQ ID NO: 15882 - protein, 24 aa, Brucella spp.
ALSSFPQNIYWIVGGVPKAGGINS

SEQ ID NO: 15883 - protein, 18 aa, Brucella spp.
GGINSLTAFFPRVAKAYL

SEQ ID NO: 15884 - protein, 25 aa, Brucella spp.
LTAFFPRVAKAYLIGEAAAQFAATL

SEQ ID NO: 15885 - protein, 19 aa, Brucella spp.
GAVPFEISDTLAAAVAHAA

SEQ ID NO: 15886 - protein, 17 aa, Brucella spp.
LGILLSFAASPAVAERI

SEQ ID NO: 15887 - protein, 17 aa, Brucella spp.
VKGARRWISLAGVSIQP

SEQ ID NO: 15888 - protein, 21 aa, Brucella spp.
FLAGLPMIWILVLGGLAICGG

SEQ ID NO: 15889 - protein, 22 aa, Brucella spp.
ILCMIIMLLFAFIVVRGLSIAL

SEQ ID NO: 15890 - protein, 22 aa, Brucella spp.
RNPVALLKTFWSLWQGNLDSRK

SEQ ID NO: 15891 - protein, 24 aa, Brucella spp.
FRRLKPKLVVGFGGYPTLPPLYAA

SEQ ID NO: 15892 - protein, 17 aa, Brucella spp.
LLPEHERARLLITQQAR

SEQ ID NO: 15893 - protein, 18 aa, Brucella spp.
ADVAPFFNDMPARMADAH

SEQ ID NO: 15894 - protein, 19 aa, Brucella spp.
ARMADAHFVIARSGASTVS

SEQ ID NO: 15895 - protein, 25 aa, Brucella spp.
ITVIGRPAMLVPFPHALDHDQAANA

SEQ ID NO: 15896 - protein, 17 aa, Brucella spp.
LVHFIGIGGIGMSGIAE

SEQ ID NO: 15897 - protein, 21 aa, Brucella spp.
MLAELMRFRRAVAIGGTHGKT

SEQ ID NO: 15898 - protein, 20 aa, Brucella spp.
LKLPADIAVVTNIDPEHLDH

SEQ ID NO: 15899 - protein, 25 aa, Brucella spp.
FRQFVENVPFYGFGVMCLDHPEVQA

SEQ ID NO: 15900 - protein, 17 aa, Brucella spp.
HPVEIRAVLKAAREATS

SEQ ID NO: 15901 - protein, 17 aa, Brucella spp.
VEIRAVLKAAREATSQA

SEQ ID NO: 15902 - protein, 19 aa, Brucella spp.
GMDKITWFRAGGPAQVLFQ

SEQ ID NO: 15903 - protein, 24 aa, Brucella spp.
KAVPEEIPLLVVGIGSNLLVRDGG

SEQ ID NO: 15904 - protein, 21 aa, Brucella spp.
RDGGVPGFVVRLSAKGFGEVE

SEQ ID NO: 15905 - protein, 23 aa, Brucella spp.
YHGIPGGIGGALRMNAGANGVET

SEQ ID NO: 15906 - protein, 23 aa, Brucella spp.
ASPDLIFTSVLFEGVPGERDDIR

SEQ ID NO: 15907 - protein, 26 aa, Brucella spp.
GIRLHWEIKRLGLFREGEQIEEFLGK

SEQ ID NO: 15908 - protein, 25 aa, Brucella spp.
AAFVLPRFLRKPFRFAVRLFQGNVN

SEQ ID NO: 15909 - protein, 22 aa, Brucella spp.
IPRHAGTVGMLGFLGATGLYGM

SEQ ID NO: 15910 - protein, 17 aa, Brucella spp.
RKVYPGTILVSLQERKA

SEQ ID NO: 15911 - protein, 17 aa, Brucella spp.
MLPESAPLKALAQVEKL

SEQ ID NO: 15912 - protein, 18 aa, Brucella spp.
SAPLKALAQVEKLDREKH

SEQ ID NO: 15913 - protein, 21 aa, Brucella spp.
LRPHEGGALLPGRTHRMEVLG

SEQ ID NO: 15914 - protein, 25 aa, Brucella spp.
ERHLVHSLPVGYTLDGERGIREPLG

SEQ ID NO: 15915 - protein, 23 aa, Brucella spp.
LDGERGIREPLGMLGDSLGVDMH

SEQ ID NO: 15916 - protein, 19 aa, Brucella spp.
DAERLKVMYGSALPSAADD

SEQ ID NO: 15917 - protein, 17 aa, Brucella spp.
YPRSVLTRIIRARVEET

SEQ ID NO: 15918 - protein, 22 aa, Brucella spp.
GMPEAARRILARNVRIGRPLGI

SEQ ID NO: 15919 - protein, 19 aa, Brucella spp.
RNVRIGRPLGIAGLPEAAK

SEQ ID NO: 15920 - protein, 17 aa, Brucella spp.
GLPEAAKGAAFAATVGL

SEQ ID NO: 15921 - protein, 19 aa, Brucella spp.
AAKGAAFAATVGLLIYPQV

SEQ ID NO: 15922 - protein, 23 aa, Brucella spp.
DITELKPRITVFGVGGGGGNAVN

SEQ ID NO: 15923 - protein, 17 aa, Brucella spp.
NAGLRGVDFVVANTDAQ

SEQ ID NO: 15924 - protein, 17 aa, Brucella spp.
VTKPFHFEGARRMKTAD

SEQ ID NO: 15925 - protein, 25 aa, Brucella spp.
DTLIVIPNQNLFRIANDKTTFADAF

SEQ ID NO: 15926 - protein, 24 aa, Brucella spp.
TFADAFAMADQVLYSGVACITDLM

SEQ ID NO: 15927 - protein, 17 aa, Brucella spp.
ACITDLMVKEGLINLDF

SEQ ID NO: 15928 - protein, 25 aa, Brucella spp.
DLMVKEGLINLDFADVRSVMREMGK

SEQ ID NO: 15929 - protein, 17 aa, Brucella spp.
AAAEAAIANPLLDETSM

SEQ ID NO: 15930 - protein, 18 aa, Brucella spp.
AAIANPLLDETSMRGAKG

SEQ ID NO: 15931 - protein, 23 aa, Brucella spp.
VDPEANIILGATFDEGLEGVIRV

SEQ ID NO: 15932 - protein, 19 aa, Brucella spp.
APAPLEFRQPVKPTAAQAK

SEQ ID NO: 15933 - protein, 18 aa, Brucella spp.
AEPEFRPQSRIFQAPAPE

SEQ ID NO: 15934 - protein, 26 aa, Brucella spp.
VQEEPRGPMGLLKRLTHGLSRREEEQ

SEQ ID NO: 15935 - protein, 21 aa, Brucella spp.
LLPADADTGILFQRSDIKDSA

SEQ ID NO: 15936 - protein, 19 aa, Brucella spp.
IDFECPLIGRQKFAHDVDE

SEQ ID NO: 15937 - protein, 25 aa, Brucella spp.
TFRKELSTARTFGFMKDVERLWAAG

SEQ ID NO: 15938 - protein, 23 aa, Brucella spp.
KDVERLWAAGLALGASLDNSLVI

SEQ ID NO: 15939 - protein, 25 aa, Brucella spp.
DLALAGLPFIGCFSSYRGGHRLNSE

SEQ ID NO: 15940 - protein, 25 aa, Brucella spp.
YTEWARKALVMAAFTNYRKGNYEEA

SEQ ID NO: 15941 - protein, 29 aa, Brucella spp.
PTSPESAYAYYIIGLSYFRQIPDVTRDQA

SEQ ID NO: 15942 - protein, 25 aa, Brucella spp.
ALARLVEAYYALGLTSEAQMAASVL

SEQ ID NO: 15943 - protein, 25 aa, Brucella spp.
VFDVPGNHPARLFLRENGFDDDGDI

SEQ ID NO: 15944 - protein, 19 aa, Brucella spp.
NDQAASVALLRDLGKRLVE

SEQ ID NO: 15945 - protein, 17 aa, Brucella spp.
ALLRDLGKRLVEIHGQH

SEQ ID NO: 15946 - protein, 24 aa, Brucella spp.
LERKAIEAPHLLEPVCKAIDEALD

SEQ ID NO: 15947 - protein, 17 aa, Brucella spp.
VEERLFALRAAARKYSV

SEQ ID NO: 15948 - protein, 17 aa, Brucella spp.
LPALKLERAEFIVEMTT

SEQ ID NO: 15949 - protein, 18 aa, Brucella spp.
RTAEGIDTVEYWVRTNPG

SEQ ID NO: 15950 - protein, 17 aa, Brucella spp.
EGIDTVEYWVRTNPGTR

SEQ ID NO: 15951 - protein, 18 aa, Brucella spp.
IDTVEYWVRTNPGTRAGP

SEQ ID NO: 15952 - protein, 29 aa, Brucella spp.
MKVASCGELSRFLLALKVALADRGSAPTL

SEQ ID NO: 15953 - protein, 24 aa, Brucella spp.
ALADRGSAPTLVFDEIDTGVGGAV

SEQ ID NO: 15954 - protein, 17 aa, Brucella spp.
VAARASTHFLIAKSATH

SEQ ID NO: 15955 - protein, 17 aa, Brucella spp.
ARASTHFLIAKSATHED

SEQ ID NO: 15956 - protein, 18 aa, Brucella spp.
VGAAPALAIFAPVVHARP

SEQ ID NO: 15957 - protein, 18 aa, Brucella spp.
LSMSIRYENGILVSGATR

SEQ ID NO: 15958 - protein, 20 aa, Brucella spp.
VTASRKLRFFAYAWGEMSDM

SEQ ID NO: 15959 - protein, 37 aa, Brucella spp.
PADTQLGMVEVFRQWGFPVNPLMKRFNSVDGLLAHYR

SEQ ID NO: 15960 - protein, 20 aa, Brucella spp.
RFNSVDGLLAHYRAIGMERP

SEQ ID NO: 15961 - protein, 20 aa, Brucella spp.
VDRLDLQTRLGFRSRSPRWA

SEQ ID NO: 15962 - protein, 17 aa, Brucella spp.
LQTRLGFRSRSPRWAIA

SEQ ID NO: 15963 - protein, 33 aa, Brucella spp.
RSRSPRWAIAHKFPAEQALTILRGIDIQVGRTG

SEQ ID NO: 15964 - protein, 18 aa, Brucella spp.
QAVERIRHFVSRNAFDIE

SEQ ID NO: 15965 - protein, 28 aa, Brucella spp.
DARREIALHRFLFGLGIRHVGEVNAKRL

SEQ ID NO: 15966 - protein, 22 aa, Brucella spp.
AKRLARAYLSYAAFKKAALEAV

SEQ ID NO: 15967 - protein, 19 aa, Brucella spp.
EAWQDMLAVEGIGSIVAEA

SEQ ID NO: 15968 - protein, 24 aa, Brucella spp.
RKKMAELGLDGFLVPRADEHQGEY

SEQ ID NO: 15969 - protein, 22 aa, Brucella spp.
VPPHAQRLGWLTGFTGSAGAAL

SEQ ID NO: 15970 - protein, 18 aa, Brucella spp.
NGKGLTIGFDPWLHTIYE

SEQ ID NO: 15971 - protein, 17 aa, Brucella spp.
IPVETNLVDAVWDDQPE

SEQ ID NO: 15972 - protein, 23 aa, Brucella spp.
LTDPSSVAWVFNIRGKDVSNTPL

SEQ ID NO: 15973 - protein, 21 aa, Brucella spp.
VSNTPLPLSFAIIPAQGEPEL

SEQ ID NO: 15974 - protein, 24 aa, Brucella spp.
ERDGVAMVNFLSWIDAQKPGTIDE

SEQ ID NO: 15975 - protein, 25 aa, Brucella spp.
RIDPETVKAFTLVLKGVIAITTARF

SEQ ID NO: 15976 - protein, 25 aa, Brucella spp.
GQDIDILARIALWKHGFDYAHGTGH

SEQ ID NO: 15977 - protein, 23 aa, Brucella spp.
KGAQELLPGMILSNEPGYYKPGA

SEQ ID NO: 15978 - protein, 21 aa, Brucella spp.
PGYYKPGAFGIRIENLIIVTE

SEQ ID NO: 15979 - protein, 19 aa, Brucella spp.
EVLPGGDIPMMGFETLTFC

SEQ ID NO: 15980 - protein, 23 aa, Brucella spp.
IPMMGFETLTFCPIDRRLVDKAL

SEQ ID NO: 15981 - protein, 19 aa, Brucella spp.
TQEELDWLNTYHAKVRAKL

SEQ ID NO: 15982 - protein, 22 aa, Brucella spp.
DLRATPAVVFFGFTHCPDVCPT

SEQ ID NO: 15983 - protein, 20 aa, Brucella spp.
DVCPTTLYELDGWLKQLGPE

SEQ ID NO: 15984 - protein, 18 aa, Brucella spp.
AGDIKAYFVTVDPERDTQ

SEQ ID NO: 15985 - protein, 17 aa, Brucella spp.
TASIFLLDKGGRFRGTI

SEQ ID NO: 15986 - protein, 18 aa, Brucella spp.
GLLLAPMLVFAASAAPAE

SEQ ID NO: 15987 - protein, 18 aa, Brucella spp.
KGITCYLASFSRGMIDRL

SEQ ID NO: 15988 - protein, 23 aa, Brucella spp.
DQIPDFVETAVFKRDVFSETHAG

SEQ ID NO: 15989 - protein, 31 aa, Brucella spp.
IIRRVVSAALWWSKPLAWILARREIRGLKTV

SEQ ID NO: 15990 - protein, 23 aa, Brucella spp.
SWTEGTPLHLARPSDPKWYRTAH

SEQ ID NO: 15991 - protein, 18 aa, Brucella spp.
LDENDAFSLGQRIRDIAV

SEQ ID NO: 15992 - protein, 30 aa, Brucella spp.
VKDKLGIAIDISLWGRRLFFAATAGATADN

SEQ ID NO: 15993 - protein, 20 aa, Brucella spp.
AEHRVPVVAFGAGSSLEGQV

SEQ ID NO: 15994 - protein, 27 aa, Brucella spp.
ALNEYLRDTGLFFPIDPGANATLGGMA

SEQ ID NO: 15995 - protein, 17 aa, Brucella spp.
VIETIQMGIPVARIELV

SEQ ID NO: 15996 - protein, 23 aa, Brucella spp.
MGIPVARIELVNTLQMQALIMHS

SEQ ID NO: 15997 - protein, 21 aa, Brucella spp.
KLPYEAQPYLFVEFHGTESGV

SEQ ID NO: 15998 - protein, 24 aa, Brucella spp.
RARHEAYLASFLLRPGCKGVSTDV

SEQ ID NO: 15999 - protein, 17 aa, Brucella spp.
VPISRLADCIGETEKDL

SEQ ID NO: 16000 - protein, 20 aa, Brucella spp.
LVVPPFVDWSGYRADFEREA

SEQ ID NO: 16001 - protein, 27 aa, Brucella spp.
DAELMPFLRGQLLIFDMRVERPRVTIS

SEQ ID NO: 16002 - protein, 17 aa, Brucella spp.
LDKDGKVDWAIRPSTPL

SEQ ID NO: 16003 - protein, 20 aa, Brucella spp.
DGKVDWAIRPSTPLDPTKIG

SEQ ID NO: 16004 - protein, 19 aa, Brucella spp.
DGRLDYAGDFSLRSSDMVA

SEQ ID NO: 16005 - protein, 24 aa, Brucella spp.
KPAEKPFFSDLRVSGKFKADRERF

SEQ ID NO: 16006 - protein, 24 aa, Brucella spp.
VSAMPIADRIAIARRILEQLPIPS

SEQ ID NO: 16007 - protein, 17 aa, Brucella spp.
RILEQLPIPSIPGNVDL

SEQ ID NO: 16008 - protein, 18 aa, Brucella spp.
LPIPSIPGNVDLRLPAVI

SEQ ID NO: 16009 - protein, 20 aa, Brucella spp.
PGNVDLRLPAVIAGGTTIRS

SEQ ID NO: 16010 - protein, 26 aa, Brucella spp.
AKGKLSVGHDFGFRGNMLVASRQPSG

SEQ ID NO: 16011 - protein, 24 aa, Brucella spp.
VKSDALQALMAFFSSGDGLAFLDG

SEQ ID NO: 16012 - protein, 20 aa, Brucella spp.
LHDGRFDFDRLLISDVAGAT

SEQ ID NO: 16013 - protein, 17 aa, Brucella spp.
DDLSRFLSLMANRYPQL

SEQ ID NO: 16014 - protein, 18 aa, Brucella spp.
LSRFLSLMANRYPQLPLF

SEQ ID NO: 16015 - protein, 33 aa, Brucella spp.
NRYPQLPLFRALSMRAANFPGLFDDSEINIIAN

SEQ ID NO: 16016 - protein, 25 aa, Brucella spp.
NLTSDFQFAKGILRFPNLVGTLNGD

SEQ ID NO: 16017 - protein, 19 aa, Brucella spp.
MESLAAIMLGQDAFEPAKP

SEQ ID NO: 16018 - protein, 19 aa, Brucella spp.
RGAFAVRPTLPLLMDMKLN

SEQ ID NO: 16019 - protein, 24 aa, Brucella spp.
AVRPTLPLLMDMKLNVAEARMDGF

SEQ ID NO: 16020 - protein, 17 aa, Brucella spp.
RMDGFGTVTGFSTRLQK

SEQ ID NO: 16021 - protein, 20 aa, Brucella spp.
LKWSGAKLNDFYRLEDGSAL

SEQ ID NO: 16022 - protein, 20 aa, Brucella spp.
GNARFDFTITGGVARMAAAN

SEQ ID NO: 16023 - protein, 18 aa, Brucella spp.
DGDAALLADLQFDLSTFG

SEQ ID NO: 16024 - protein, 19 aa, Brucella spp.
AALLADLQFDLSTFGVSGN

SEQ ID NO: 16025 - protein, 21 aa, Brucella spp.
TGIAPQVAFSLGGHYSQPTVN

SEQ ID NO: 16026 - protein, 20 aa, Brucella spp.
VTLMSDIVNLRQFKKQKARD

SEQ ID NO: 16027 - protein, 21 aa, Brucella spp.
QAEQNRILFGRTKVEKDFARA

SEQ ID NO: 16028 - protein, 19 aa, Brucella spp.
VVEKIVKHLGIALRNRDSS

SEQ ID NO: 16029 - protein, 19 aa, Brucella spp.
NKHRVTFYYLVAKQLGKLG

SEQ ID NO: 16030 - protein, 17 aa, Brucella spp.
LEEGFPVLTTKKLHLRS

SEQ ID NO: 16031 - protein, 19 aa, Brucella spp.
RSIIHELLWFLKGDTNIAY

SEQ ID NO: 16032 - protein, 18 aa, Brucella spp.
NGDLGPVYGYQWRSWPAP

SEQ ID NO: 16033 - protein, 21 aa, Brucella spp.
LPPCHCLFQFYVANGRLSCQL

SEQ ID NO: 16034 - protein, 26 aa, Brucella spp.
YQRSADIFLGVPFNIASYALLTMMIA

SEQ ID NO: 16035 - protein, 20 aa, Brucella spp.
PFNIASYALLTMMIAQVTGL

SEQ ID NO: 16036 - protein, 24 aa, Brucella spp.
HINPDVKDLFAFRFEDFRLDGYEA

SEQ ID NO: 16037 - protein, 21 aa, Brucella spp.
QENDMPWRLSTDLKRFKALTL

SEQ ID NO: 16038 - protein, 17 aa, Brucella spp.
LALARKFAAEGGVDEIC

SEQ ID NO: 16039 - protein, 20 aa, Brucella spp.
PLADRLHLTRVLSVIEGDTY

SEQ ID NO: 16040 - protein, 36 aa, Brucella spp.
GGRKGSNRPIYFLIGAAVLGFWLFQSVYTVQPDELA

SEQ ID NO: 16041 - protein, 24 aa, Brucella spp.
VQPDELAVELRFGKPKEEVSEPGL

SEQ ID NO: 16042 - protein, 29 aa, Brucella spp.
KEEVSEPGLHFHWWPFETYEKAQIVEKQI

SEQ ID NO: 16043 - protein, 20 aa, Brucella spp.
PEVTRNRLFLETMEEVLKGT

SEQ ID NO: 16044 - protein, 23 aa, Brucella spp.
PGKDVVPYLPLHELMQKQPSTGV

SEQ ID NO: 16045 - protein, 24 aa, Brucella spp.
DDIACDIPLPLGMEASEADASLRA

SEQ ID NO: 16046 - protein, 25 aa, Brucella spp.
RAMNGEIAFEPALRERVALLKGLPL

SEQ ID NO: 16047 - protein, 19 aa, Brucella spp.
VALLKGLPLSVIDKVISTR

SEQ ID NO: 16048 - protein, 31 aa, Brucella spp.
LIDQGVESIFGYPGGAVLPIYDGLFQQDQIQ

SEQ ID NO: 16049 - protein, 18 aa, Brucella spp.
RLLRELVEISNFPITSTL

SEQ ID NO: 16050 - protein, 19 aa, Brucella spp.
PASGKNWLGMLGMHGTYEA

SEQ ID NO: 16051 - protein, 20 aa, Brucella spp.
MPQYAIERLYELTRNRNTYI

SEQ ID NO: 16052 - protein, 18 aa, Brucella spp.
FEQPNRWLTSGGLGTMGY

SEQ ID NO: 16053 - protein, 17 aa, Brucella spp.
WLTSGGLGTMGYGLPAA

SEQ ID NO: 16054 - protein, 24 aa, Brucella spp.
VKLAEAYGAHGIRCEKPGDLDAAI

SEQ ID NO: 16055 - protein, 20 aa, Brucella spp.
IDIDKPVIFDCRVANLANCF

SEQ ID NO: 16056 - protein, 19 aa, Brucella spp.
NLANCFPMIPSGKAHNEML

SEQ ID NO: 16057 - protein, 24 aa, Brucella spp.
DNEPGVLARVIGLFSGRGYNIESL

SEQ ID NO: 16058 - protein, 22 aa, Brucella spp.
ERPIERELALVKVAGKGEARAE

SEQ ID NO: 16059 - protein, 22 aa, Brucella spp.
RAETLRLADAFKAKVVDATTDH

SEQ ID NO: 16060 - protein, 18 aa, Brucella spp.
IMKPLGLVEICRTGVAAM

SEQ ID NO: 16061 - protein, 25 aa, Brucella spp.
QWLKAGRSPIFRLFGYAGTGKTTLA

SEQ ID NO: 16062 - protein, 18 aa, Brucella spp.
PGQLPPISGGGFFTEHEP

SEQ ID NO: 16063 - protein, 18 aa, Brucella spp.
DPTKGLLNGSLWKVMTSS

SEQ ID NO: 16064 - protein, 19 aa, Brucella spp.
RGVAKIKLLKAQFEDPDTE

SEQ ID NO: 16065 - protein, 17 aa, Brucella spp.
DDFDYGYALTVHKAQGS

SEQ ID NO: 16066 - protein, 17 aa, Brucella spp.
FDYGYALTVHKAQGSQW

SEQ ID NO: 16067 - protein, 20 aa, Brucella spp.
IEGFPSEAFLDLVEKHEPEQ

SEQ ID NO: 16068 - protein, 24 aa, Brucella spp.
DHGWDFMSKADFLAPIVARLKGRG

SEQ ID NO: 16069 - protein, 20 aa, Brucella spp.
IPQLAEVSIGHGLTADALMY

SEQ ID NO: 16070 - protein, 18 aa, Brucella spp.
VSIGHGLTADALMYGIPV

SEQ ID NO: 16071 - protein, 24 aa, Brucella spp.
ARSDILGVVSLIFWALTLVVTVKY

SEQ ID NO: 16072 - protein, 17 aa, Brucella spp.
GRPDLILGVGICGAALF

SEQ ID NO: 16073 - protein, 18 aa, Brucella spp.
LILGVGICGAALFFGDAV

SEQ ID NO: 16074 - protein, 23 aa, Brucella spp.
GRKPIVRAWLWIVFPCLLLNYFG

SEQ ID NO: 16075 - protein, 25 aa, Brucella spp.
LWIVFPCLLLNYFGQAAFILSHGEA

SEQ ID NO: 16076 - protein, 28 aa, Brucella spp.
GEAAALPFFQMIPSFALWPMVLLATAAT

SEQ ID NO: 16077 - protein, 25 aa, Brucella spp.
QIYIPRVNLLLGLAVVILVLGFEKS

SEQ ID NO: 16078 - protein, 34 aa, Brucella spp.
IVMTRIWNWRVSRALPIILGFLVIDMLFFSANII

SEQ ID NO: 16079 - protein, 20 aa, Brucella spp.
NERFMLVTLTFGYMQQPNIP

SEQ ID NO: 16080 - protein, 17 aa, Brucella spp.
LGLCRRLGWKFDIMTTS

SEQ ID NO: 16081 - protein, 21 aa, Brucella spp.
LCRRLGWKFDIMTTSFFLSRR

SEQ ID NO: 16082 - protein, 20 aa, Brucella spp.
KFDIMTTSFFLSRRSLKASV

SEQ ID NO: 16083 - protein, 20 aa, Brucella spp.
MPLWQDKLFILLARTASDAT

SEQ ID NO: 16084 - protein, 24 aa, Brucella spp.
QAVLCGGVVELIRTGFEVLVEAGY

SEQ ID NO: 16085 - protein, 25 aa, Brucella spp.
ECLNEMKLIVDLIYEGGIANMNYSI

SEQ ID NO: 16086 - protein, 17 aa, Brucella spp.
DWMQEWKAGAARFKGIR

SEQ ID NO: 16087 - protein, 17 aa, Brucella spp.
LRAMMPWIEKNKLVDKA

SEQ ID NO: 16088 - protein, 17 aa, Brucella spp.
RASEIRELLKLLERPDI

SEQ ID NO: 16089 - protein, 24 aa, Brucella spp.
LLKLLERPDIISFAGGIPDPALFP

SEQ ID NO: 16090 - protein, 23 aa, Brucella spp.
ISEGYKPLRTWLVGELAKIGIPC

SEQ ID NO: 16091 - protein, 20 aa, Brucella spp.
AGGQVKFAYLSADFSNPTGE

SEQ ID NO: 16092 - protein, 19 aa, Brucella spp.
PVIEDAAYQYLRYNGDAIP

SEQ ID NO: 16093 - protein, 19 aa, Brucella spp.
NGDAIPPILALDIARNGGD

SEQ ID NO: 16094 - protein, 18 aa, Brucella spp.
GSFSKTLAPGLRVGYVVA

SEQ ID NO: 16095 - protein, 24 aa, Brucella spp.
HWTKPEGGMFVWVTLPEGMDGASL

SEQ ID NO: 16096 - protein, 25 aa, Brucella spp.
ALNAFEYGYLFKMIGYGYRHKYLID

SEQ ID NO: 16097 - protein, 20 aa, Brucella spp.
IGGEPLSLFVAHLKSMSGAR

SEQ ID NO: 16098 - protein, 18 aa, Brucella spp.
VRLAEARAIRRIIEEKFG

SEQ ID NO: 16099 - protein, 17 aa, Brucella spp.
SALNVLLGDGFAVNLVE

SEQ ID NO: 16100 - protein, 18 aa, Brucella spp.
VMDRWTLYHTRGPLERHL

SEQ ID NO: 16101 - protein, 17 aa, Brucella spp.
IRRGQPWRTIFPPEQNV

SEQ ID NO: 16102 - protein, 19 aa, Brucella spp.
LYEVFDVFADKALAGNPLA

SEQ ID NO: 16103 - protein, 26 aa, Brucella spp.
SLPHVGGRPLPIYVYCRETILFNSHF

SEQ ID NO: 16104 - protein, 30 aa, Brucella spp.
VDDRPIIVPMTFRFSGGSFYSFTTDGQKTN

SEQ ID NO: 16105 - protein, 17 aa, Brucella spp.
GGSFYSFTTDGQKTNAM

SEQ ID NO: 16106 - protein, 19 aa, Brucella spp.
RALKPVFFRVDIEKLSGHQ

SEQ ID NO: 16107 - protein, 24 aa, Brucella spp.
LLHLEGFMIVLLVLLPFTMPGRPL

SEQ ID NO: 16108 - protein, 17 aa, Brucella spp.
VNICVLSIYALLGSLDP

SEQ ID NO: 16109 - protein, 24 aa, Brucella spp.
GLSPKFVRLFLITVRYVSVFRAET

SEQ ID NO: 16110 - protein, 17 aa, Brucella spp.
AEAHRLNLFATVEGGTV

SEQ ID NO: 16111 - protein, 21 aa, Brucella spp.
GGTVHGYGFFVGGGRPSEAQL

SEQ ID NO: 16112 - protein, 20 aa, Brucella spp.
RARFSDIVSGIAVIIGLAGL

SEQ ID NO: 16113 - protein, 25 aa, Brucella spp.
GIAVIIGLAGLFLWAKSRGRASHSD

SEQ ID NO: 16114 - protein, 17 aa, Brucella spp.
EERKIDGKRAWRAKDEI

SEQ ID NO: 16115 - protein, 18 aa, Brucella spp.
EITEPGASLYFVEPQPYW

SEQ ID NO: 16116 - protein, 20 aa, Brucella spp.
EPGASLYFVEPQPYWEPAEK

SEQ ID NO: 16117 - protein, 25 aa, Brucella spp.
TFSYAMPRAGWWGFAALTEGDEKMK

SEQ ID NO: 16118 - protein, 24 aa, Brucella spp.
SEIVEGNSLIRFIDINLRGAGQVI

SEQ ID NO: 16119 - protein, 24 aa, Brucella spp.
ALLAPRPAMWFILVIGAAVSTVVM

SEQ ID NO: 16120 - protein, 25 aa, Brucella spp.
ALTFPFVLTTWFLVLAAYAFGHLPI

SEQ ID NO: 16121 - protein, 25 aa, Brucella spp.
VGLGCVFFRPSLRVTLFAVLGTVFT

SEQ ID NO: 16122 - protein, 22 aa, Brucella spp.
TFTAPFVFVTWLFLLPKTNLEP

SEQ ID NO: 16123 - protein, 20 aa, Brucella spp.
RNSFALALLQPAVRGKLDRE

SEQ ID NO: 16124 - protein, 17 aa, Brucella spp.
GSVSTGVSHPWGGYASG

SEQ ID NO: 16125 - protein, 19 aa, Brucella spp.
TGVSHPWGGYASGSLQGRS

SEQ ID NO: 16126 - protein, 24 aa, Brucella spp.
SDGIDYAVGAAFTGTQGYDFTTPE

SEQ ID NO: 16127 - protein, 18 aa, Brucella spp.
TQGYDFTTPEAFGHEPDD

SEQ ID NO: 16128 - protein, 17 aa, Brucella spp.
FTTPEAFGHEPDDDGFL

SEQ ID NO: 16129 - protein, 27 aa, Brucella spp.
LQGSFNFALSKDFDWGKIYADGLFSRG

SEQ ID NO: 16130 - protein, 22 aa, Brucella spp.
RKGIEGSDWFETRRYGVFASTE

SEQ ID NO: 16131 - protein, 25 aa, Brucella spp.
GASYEILPDLVLRSSYATGFRAPTF

SEQ ID NO: 16132 - protein, 17 aa, Brucella spp.
PTFNELYYPGFANPDLQ

SEQ ID NO: 16133 - protein, 18 aa, Brucella spp.
ELYYPGFANPDLQPEKSR

SEQ ID NO: 16134 - protein, 24 aa, Brucella spp.
EKSRSVEVGLNWQATASTSLDMAL

SEQ ID NO: 16135 - protein, 21 aa, Brucella spp.
EATLSHSFNEQWGIKGMVDLK

SEQ ID NO: 16136 - protein, 21 aa, Brucella spp.
FNEQWGIKGMVDLKRPVDEDS

SEQ ID NO: 16137 - protein, 19 aa, Brucella spp.
YRERFKAAAEVNFKPVEKL

SEQ ID NO: 16138 - protein, 21 aa, Brucella spp.
DYVTADFVALYSIDKQSQLKF

SEQ ID NO: 16139 - protein, 17 aa, Brucella spp.
SQLKFSVENIFDKDYET

SEQ ID NO: 16140 - protein, 17 aa, Brucella spp.
FSVENIFDKDYETSSGY

SEQ ID NO: 16141 - protein, 24 aa, Brucella spp.
TRRLCLAAGLALFAPLPANAADIA

SEQ ID NO: 16142 - protein, 22 aa, Brucella spp.
FLQKPDLVLAGTFSSRATVGLL

SEQ ID NO: 16143 - protein, 18 aa, Brucella spp.
RATVGLLRRLGIRVEEFA

SEQ ID NO: 16144 - protein, 19 aa, Brucella spp.
IRVEEFAPARSFEDIQEHL

SEQ ID NO: 16145 - protein, 25 aa, Brucella spp.
VLVMREIRLPRALLALLIGASLGLS

SEQ ID NO: 16146 - protein, 20 aa, Brucella spp.
LSLLFPLALPLLALAGAFVS

SEQ ID NO: 16147 - protein, 25 aa, Brucella spp.
SMTHVALVIPFILIGWLMLLSLGRS

SEQ ID NO: 16148 - protein, 18 aa, Brucella spp.
FILIGWLMLLSLGRSLDS

SEQ ID NO: 16149 - protein, 19 aa, Brucella spp.
PGRELKLGVLTAIIGAPFF

SEQ ID NO: 16150 - protein, 20 aa, Brucella spp.
LKLGVLTAIIGAPFFLWLVF

SEQ ID NO: 16151 - protein, 30 aa, Brucella spp.
YLPQERDVAWPVSVHMLVSLGRSALKPVFA

SEQ ID NO: 16152 - protein, 19 aa, Brucella spp.
VFTPQRLRDVYGIRARIMM

SEQ ID NO: 16153 - protein, 20 aa, Brucella spp.
LRDVYGIRARIMMVDGEFIV

SEQ ID NO: 16154 - protein, 18 aa, Brucella spp.
VLSLLPLDDFVDRPAAVM

SEQ ID NO: 16155 - protein, 26 aa, Brucella spp.
EGRKIPVEPIERFAFYDRARGAFAII

SEQ ID NO: 16156 - protein, 17 aa, Brucella spp.
LGIDNLVFIAILADKLP

SEQ ID NO: 16157 - protein, 17 aa, Brucella spp.
IDNLVFIAILADKLPPH

SEQ ID NO: 16158 - protein, 20 aa, Brucella spp.
ARLVGLGLALVMRLVLLASI

SEQ ID NO: 16159 - protein, 27 aa, Brucella spp.
LALVMRLVLLASISWIVTLREPLISIM

SEQ ID NO: 16160 - protein, 19 aa, Brucella spp.
IVHAVFWQVIVQIVVLDAV

SEQ ID NO: 16161 - protein, 28 aa, Brucella spp.
HPTVVILCLGFLMIIGFSLVAEGFGLHI

SEQ ID NO: 16162 - protein, 25 aa, Brucella spp.
EGFGLHIPKGYLYAAIGFSVLVEAA

SEQ ID NO: 16163 - protein, 18 aa, Brucella spp.
DRYTTLAGYALWHLGHLP

SEQ ID NO: 16164 - protein, 24 aa, Brucella spp.
IVIGLCLAFIFGAIATRLKISPLV

SEQ ID NO: 16165 - protein, 17 aa, Brucella spp.
ISPLVGYLLAGVIAGPH

SEQ ID NO: 16166 - protein, 24 aa, Brucella spp.
QLAEIGVILLMFGVGLHFSLKDLL

SEQ ID NO: 16167 - protein, 22 aa, Brucella spp.
FGVGLHFSLKDLLSVKAIAVPG

SEQ ID NO: 16168 - protein, 19 aa, Brucella spp.
LALGWDVQAGMVFGLALST

SEQ ID NO: 16169 - protein, 19 aa, Brucella spp.
RIAIGWLIVEDLAMVMALV

SEQ ID NO: 16170 - protein, 17 aa, Brucella spp.
IVEDLAMVMALVLLPAI

SEQ ID NO: 16171 - protein, 20 aa, Brucella spp.
EDLAMVMALVLLPAIASVTG

SEQ ID NO: 16172 - protein, 18 aa, Brucella spp.
VVLFIVLMLVVGRKVIPW

SEQ ID NO: 16173 - protein, 19 aa, Brucella spp.
GRKVIPWLLNVVAQTGSRE

SEQ ID NO: 16174 - protein, 18 aa, Brucella spp.
SRELFRLGVLAIALGVAF

SEQ ID NO: 16175 - protein, 17 aa, Brucella spp.
LGVLAIALGVAFGAAHL

SEQ ID NO: 16176 - protein, 27 aa, Brucella spp.
EESLPLRDAFAVLFFISVGMLFDPMSL

SEQ ID NO: 16177 - protein, 18 aa, Brucella spp.
LPLLGTLAIILIGKSVAA

SEQ ID NO: 16178 - protein, 23 aa, Brucella spp.
AQIGEFSFILAGLGVSLNLLPPA

SEQ ID NO: 16179 - protein, 32 aa, Brucella spp.
DRQHGFMLFVTCVLSFTAFLFTVDFSSQAGDA

SEQ ID NO: 16180 - protein, 22 aa, Brucella spp.
EAIAAKIKTVWLGDGNAALLTK

SEQ ID NO: 16181 - protein, 17 aa, Brucella spp.
EAAQIFQPLPALRGHFG

SEQ ID NO: 16182 - protein, 39 aa, Brucella spp.
ISLWRIVRSWWRFVVTFKLESFLAAAFFALAAALVLQFG

SEQ ID NO: 16183 - protein, 17 aa, Brucella spp.
ALVLQFGAQRFLGAFYR

SEQ ID NO: 16184 - protein, 17 aa, Brucella spp.
FGAQRFLGAFYRRDPSV

SEQ ID NO: 16185 - protein, 22 aa, Brucella spp.
SYLSRLSVAFWSTVIPSAAVGV

SEQ ID NO: 16186 - protein, 19 aa, Brucella spp.
TDIASLFQSLFIVLGLVFF

SEQ ID NO: 16187 - protein, 24 aa, Brucella spp.
FQSLFIVLGLVFFIHRLAVACISS

SEQ ID NO: 16188 - protein, 20 aa, Brucella spp.
SSDMPQWRLVQVAPRPGHLL

SEQ ID NO: 16189 - protein, 23 aa, Brucella spp.
QVAPRPGHLLAWLVTATALTSGL

SEQ ID NO: 16190 - protein, 27 aa, Brucella spp.
GAVRAWPRAFRIFLILMGLLPILTALS

SEQ ID NO: 16191 - protein, 20 aa, Brucella spp.
FLVTMYMGFLTGRAISEEQA

SEQ ID NO: 16192 - protein, 19 aa, Brucella spp.
PLVLMQLGFQWAELKSTFY

SEQ ID NO: 16193 - protein, 25 aa, Brucella spp.
GLLSGVLLFLIGYVLTRWFQNWLDN

SEQ ID NO: 16194 - protein, 24 aa, Brucella spp.
GYVGLCLAALMGISAAGFNLANLA

SEQ ID NO: 16195 - protein, 22 aa, Brucella spp.
GGLSLGIGFGLQNIVQNFVSGL

SEQ ID NO: 16196 - protein, 20 aa, Brucella spp.
PRRVHALLLEIVRGHPSILK

SEQ ID NO: 16197 - protein, 19 aa, Brucella spp.
IKNELRFQIVERFHEQGLS

SEQ ID NO: 16198 - protein, 22 aa, Brucella spp.
LGKPFLGAAVILTFSMGGAYAA

SEQ ID NO: 16199 - protein, 17 aa, Brucella spp.
CPSGCFVTFPNGDRAAL

SEQ ID NO: 16200 - protein, 22 aa, Brucella spp.
GGEIGRAQWLQALACGVPSSVH

SEQ ID NO: 16201 - protein, 19 aa, Brucella spp.
KPQLMAAVMESFAKVGDGA

SEQ ID NO: 16202 - protein, 19 aa, Brucella spp.
ADVPVVLVGDIDRGGVIAS

SEQ ID NO: 16203 - protein, 22 aa, Brucella spp.
QEDRAMVRGFLINKFRGDISLF

SEQ ID NO: 16204 - protein, 31 aa, Brucella spp.
SLAAITRFTGWRSFGVVPWLKAVSRLPAEDS

SEQ ID NO: 16205 - protein, 18 aa, Brucella spp.
KALIVAVPMLPRIANFDD

SEQ ID NO: 16206 - protein, 18 aa, Brucella spp.
VPMLPRIANFDDLDPLKA

SEQ ID NO: 16207 - protein, 28 aa, Brucella spp.
RGGHVLGICGGFQMLGRRISDPAGIEGN

SEQ ID NO: 16208 - protein, 22 aa, Brucella spp.
FSADRFRHHFLRALGVEGGQMN

SEQ ID NO: 16209 - protein, 23 aa, Brucella spp.
DEEGAELPFGRLGNTMLANLVAG

SEQ ID NO: 16210 - protein, 27 aa, Brucella spp.
ITVQNGIFWGLAGFFAVAFLPALGLSP

SEQ ID NO: 16211 - protein, 20 aa, Brucella spp.
RHELWAKVLGLVLIVAPHLY

SEQ ID NO: 16212 - protein, 25 aa, Brucella spp.
LFMWAVIGLALGWFIQHYASSEMEG

SEQ ID NO: 16213 - protein, 18 aa, Brucella spp.
SGLQPLYLATGRAFDTEM

SEQ ID NO: 16214 - protein, 20 aa, Brucella spp.
VLVDCLTLWITNLMMAERDM

SEQ ID NO: 16215 - protein, 24 aa, Brucella spp.
VAALPDLAGPVVFVSNEVGLGIVP

SEQ ID NO: 16216 - protein, 17 aa, Brucella spp.
TVITGFLGSGKTTMIRN

SEQ ID NO: 16217 - protein, 19 aa, Brucella spp.
ANGKRIALIINEFGDLGVD

SEQ ID NO: 16218 - protein, 30 aa, Brucella spp.
SGLALPQPLVAAFNWPEIKTQVTVDGVVTV

SEQ ID NO: 16219 - protein, 22 aa, Brucella spp.
FGKLGADVLLGLGVGTEDDIVN

SEQ ID NO: 16220 - protein, 25 aa, Brucella spp.
VIAEHDILRLKGFVDVPGKPMRLVV

SEQ ID NO: 16221 - protein, 18 aa, Brucella spp.
PRIEHYFDRPWGKDETRS

SEQ ID NO: 16222 - protein, 17 aa, Brucella spp.
STRLVVIGLHDIDEAAI

SEQ ID NO: 16223 - protein, 25 aa, Brucella spp.
APDMPSLRLANFLGLTHPMSVDAYV

SEQ ID NO: 16224 - protein, 28 aa, Brucella spp.
RIIGGETYWPYGLEALHACAITHGAKMA

SEQ ID NO: 16225 - protein, 17 aa, Brucella spp.
ERDDLWHYLIESGAANT

SEQ ID NO: 16226 - protein, 24 aa, Brucella spp.
AAPLLKAGLWWPGEAVSSLTSVQR

SEQ ID NO: 16227 - protein, 21 aa, Brucella spp.
ARGLNPLPIFVSSLKDPLSAA

SEQ ID NO: 16228 - protein, 18 aa, Brucella spp.
VDGRVLSRAVSFKSAQQF

SEQ ID NO: 16229 - protein, 19 aa, Brucella spp.
DRVAFVAELAANWVRLKRK

SEQ ID NO: 16230 - protein, 17 aa, Brucella spp.
FVAELAANWVRLKRKPP

SEQ ID NO: 16231 - protein, 22 aa, Brucella spp.
PPAERRVALILANYPNRDGRLG

SEQ ID NO: 16232 - protein, 25 aa, Brucella spp.
ARELDAFALPLMRFGETFVGIQPAR

SEQ ID NO: 16233 - protein, 24 aa, Brucella spp.
LVPPHGYIAYYAYLRAVAGVDAVV

SEQ ID NO: 16234 - protein, 24 aa, Brucella spp.
KHGNLEWLPGKALALSQNCYPEAV

SEQ ID NO: 16235 - protein, 23 aa, Brucella spp.
AVFGPMPHIYPFIVNDPGEGTQA

SEQ ID NO: 16236 - protein, 20 aa, Brucella spp.
LKAQILDLVRDIGLDRDAGI

SEQ ID NO: 16237 - protein, 18 aa, Brucella spp.
MQIRDGLHVFGLAPQARL

SEQ ID NO: 16238 - protein, 17 aa, Brucella spp.
VPCPEDWTQTRAVLQSI

SEQ ID NO: 16239 - protein, 18 aa, Brucella spp.
IDGFLAALSGRFVPPGPS

SEQ ID NO: 16240 - protein, 25 aa, Brucella spp.
QDHGEWPTSFGLTAWGTSNMRTGGD

SEQ ID NO: 16241 - protein, 20 aa, Brucella spp.
IAQALALIGVQPVWDMASRR

SEQ ID NO: 16242 - protein, 23 aa, Brucella spp.
PRVDVTLRISGFFRDAFPEQIAL

SEQ ID NO: 16243 - protein, 27 aa, Brucella spp.
GRNDLAEAWLVWGGYAYGAGEEGQAER

SEQ ID NO: 16244 - protein, 19 aa, Brucella spp.
RAANPKWIAGVMRHGYKGA

SEQ ID NO: 16245 - protein, 26 aa, Brucella spp.
GAAEIAATVDYLFAFAATTGKVGNHH

SEQ ID NO: 16246 - protein, 22 aa, Brucella spp.
KSTAGFGMVFRALGHGMKIGVV

SEQ ID NO: 16247 - protein, 18 aa, Brucella spp.
GHGMKIGVVQFVKGSWDT

SEQ ID NO: 16248 - protein, 17 aa, Brucella spp.
IGVVQFVKGSWDTGERW

SEQ ID NO: 16249 - protein, 19 aa, Brucella spp.
GSWDTGERWVLEKFPEQVT

SEQ ID NO: 16250 - protein, 24 aa, Brucella spp.
LEKFPEQVTISALGEGFTWETQDR

SEQ ID NO: 16251 - protein, 23 aa, Brucella spp.
LCDELNIVLRYDYLPVEEVTEVL

SEQ ID NO: 16252 - protein, 18 aa, Brucella spp.
LASELLLLLHVVVADGNQ

SEQ ID NO: 16253 - protein, 18 aa, Brucella spp.
IAAFKEIAANNFGIPPEE

SEQ ID NO: 16254 - protein, 17 aa, Brucella spp.
NMLAEMAPERRLALLSD

SEQ ID NO: 16255 - protein, 24 aa, Brucella spp.
EMAPERRLALLSDLMKIACSDHRL

SEQ ID NO: 16256 - protein, 20 aa, Brucella spp.
HYGCELRFFDASRLEDETPR

SEQ ID NO: 16257 - protein, 20 aa, Brucella spp.
LIENCPVCIYAGSLVPKEVV

SEQ ID NO: 16258 - protein, 23 aa, Brucella spp.
LTIPELNQTIILTRTSMKSSAMP

SEQ ID NO: 16259 - protein, 24 aa, Brucella spp.
GADCPVVVAYRVGWPDEQILRGTL

SEQ ID NO: 16260 - protein, 19 aa, Brucella spp.
IPPGENVFLALGRQHIAPF

SEQ ID NO: 16261 - protein, 19 aa, Brucella spp.
PRHCEIILARPGDYDAEAD

SEQ ID NO: 16262 - protein, 21 aa, Brucella spp.
ARDLALPVMMIARPPVAAKTV

SEQ ID NO: 16263 - protein, 24 aa, Brucella spp.
LITGEFPDPVGIILPKGEVPYFQL

SEQ ID NO: 16264 - protein, 22 aa, Brucella spp.
LPKGEVPYFQLAYEGLGEGYAM

SEQ ID NO: 16265 - protein, 25 aa, Brucella spp.
ICAEYGLPADLVITISVPGGEEIAQ

SEQ ID NO: 16266 - protein, 24 aa, Brucella spp.
KTWNPRLGIIGGISILGTTGVVHP

SEQ ID NO: 16267 - protein, 21 aa, Brucella spp.
PFSCSAWIHSIHRGIDVARAA

SEQ ID NO: 16268 - protein, 17 aa, Brucella spp.
LTQSIGIDIAGPIALEA

SEQ ID NO: 16269 - protein, 17 aa, Brucella spp.
FNLDPWAMRPELISALS

SEQ ID NO: 16270 - protein, 22 aa, Brucella spp.
ARLLDLPVVLVVDCARQSHSIA

SEQ ID NO: 16271 - protein, 25 aa, Brucella spp.
RDDAFAFAYMHLFEGWRRRGAEISF

SEQ ID NO: 16272 - protein, 18 aa, Brucella spp.
RRGAEISFFSPLADEAPK

SEQ ID NO: 16273 - protein, 19 aa, Brucella spp.
VYGECGGYMVLGKTLEDAA

SEQ ID NO: 16274 - protein, 26 aa, Brucella spp.
GYRLLEPLGGLPWDMPLKAHEFHYAS

SEQ ID NO: 16275 - protein, 20 aa, Brucella spp.
HFPLPEFSPEIWNRLPDEGL

SEQ ID NO: 16276 - protein, 33 aa, Brucella spp.
EAEAAPLVVLKSFGKFFGLAGIRLGFAVANADY

SEQ ID NO: 16277 - protein, 19 aa, Brucella spp.
YAARLRLRLGPWAVSGPAL

SEQ ID NO: 16278 - protein, 24 aa, Brucella spp.
ILVRKFDYAPDWLRIGLAHDDAAL

SEQ ID NO: 16279 - protein, 25 aa, Brucella spp.
LLDRFIGDLPLLWQRISHPVVLLGK

SEQ ID NO: 16280 - protein, 24 aa, Brucella spp.
GLVAACIFAGLVIRSILPHAGTAG

SEQ ID NO: 16281 - protein, 20 aa, Brucella spp.
AEVVIVAILLAQKSLADHVQ

SEQ ID NO: 16282 - protein, 19 aa, Brucella spp.
GIVAPAFWFLVGGLPGLFA

SEQ ID NO: 16283 - protein, 25 aa, Brucella spp.
FLVGGLPGLFAYKFINTADSMIGHL

SEQ ID NO: 16284 - protein, 19 aa, Brucella spp.
ANYIPARLTGLLAALATSL

SEQ ID NO: 16285 - protein, 24 aa, Brucella spp.
NAGWPEAAFAGALGLALAGPRQYG

SEQ ID NO: 16286 - protein, 23 aa, Brucella spp.
EARDIDAALVLFWSTMSLMTGLV

SEQ ID NO: 16287 - protein, 21 aa, Brucella spp.
VRVGLAAPLSGTFAPLGNQLV

SEQ ID NO: 16288 - protein, 25 aa, Brucella spp.
RFVEQNIRIATGFLCPEALETALPI

SEQ ID NO: 16289 - protein, 17 aa, Brucella spp.
FLCPEALETALPILSQR

SEQ ID NO: 16290 - protein, 25 aa, Brucella spp.
EALETALPILSQRNIPIIISDVSEL

SEQ ID NO: 16291 - protein, 26 aa, Brucella spp.
TLAERRAASPLPTFRLTTGLNKETQA

SEQ ID NO: 16292 - protein, 18 aa, Brucella spp.
TQATGSFLGSLWRAQPFA

SEQ ID NO: 16293 - protein, 20 aa, Brucella spp.
FLGSLWRAQPFAIIDDGTIE

SEQ ID NO: 16294 - protein, 17 aa, Brucella spp.
QQLQPVFTDTYRPGLDK

SEQ ID NO: 16295 - protein, 17 aa, Brucella spp.
PVSAPTISLPRFTPTSY

SEQ ID NO: 16296 - protein, 19 aa, Brucella spp.
PTISLPRFTPTSYVDPALA

SEQ ID NO: 16297 - protein, 30 aa, Brucella spp.
AQPCITAAANKYFLPERVISAVNSRPGAGG

SEQ ID NO: 16298 - protein, 25 aa, Brucella spp.
AGGGMDVDLKVDLRTAVCHLNSSGG

SEQ ID NO: 16299 - protein, 24 aa, Brucella spp.
ITTSGELRFGINLLHPPSDLTLAN

SEQ ID NO: 16300 - protein, 17 aa, Brucella spp.
YETYVRMAGPFRTGQTI

SEQ ID NO: 16301 - protein, 17 aa, Brucella spp.
HGVELSIQPGISAAMAA

SEQ ID NO: 16302 - protein, 22 aa, Brucella spp.
SRIGAPLGHDFCIISLSDNLKP

SEQ ID NO: 16303 - protein, 26 aa, Brucella spp.
RLALAAEADLAMAFYNPISKARPHQL

SEQ ID NO: 16304 - protein, 19 aa, Brucella spp.
GETPVVLGRDIGRAGETTR

SEQ ID NO: 16305 - protein, 21 aa, Brucella spp.
RAGETTRVMTLGALTPGDVDM

SEQ ID NO: 16306 - protein, 24 aa, Brucella spp.
PGDPELITLKALRLLKSAPVVAYH

SEQ ID NO: 16307 - protein, 23 aa, Brucella spp.
LSPEQVLLPLIYPVTTEKLPDHM

SEQ ID NO: 16308 - protein, 20 aa, Brucella spp.
EGDPFFYGSFMYIHDRLAEK

SEQ ID NO: 16309 - protein, 18 aa, Brucella spp.
AQTEAAAIMKLGKNLDKV

SEQ ID NO: 16310 - protein, 22 aa, Brucella spp.
PADLEKLAVRVIHACGMVDVAN

SEQ ID NO: 16311 - protein, 17 aa, Brucella spp.
LPADNRVIYTLGDPSVP

SEQ ID NO: 16312 - protein, 17 aa, Brucella spp.
ADNRVIYTLGDPSVPEL

SEQ ID NO: 16313 - protein, 23 aa, Brucella spp.
GNTRSAAALDLWLPHIEGSIVAI

SEQ ID NO: 16314 - protein, 23 aa, Brucella spp.
PKPALIIGMPVGFVGAAESKDEL

SEQ ID NO: 16315 - protein, 22 aa, Brucella spp.
RRSACPGLSRMVMAKDGAIARI

SEQ ID NO: 16316 - protein, 17 aa, Brucella spp.
MISHPGDIWLSATEEGK

SEQ ID NO: 16317 - protein, 27 aa, Brucella spp.
NNVPPFIDALLRCFLRNGAARMKQLTS

SEQ ID NO: 16318 - protein, 28 aa, Brucella spp.
VRESLPFAIEPAYGWKRKATVAHAHLGQ

SEQ ID NO: 16319 - protein, 24 aa, Brucella spp.
SNHYIGAMPLLGRLTPLQLRELAR

SEQ ID NO: 16320 - protein, 19 aa, Brucella spp.
RLTPWQGILLPNIAPGETD

SEQ ID NO: 16321 - protein, 22 aa, Brucella spp.
AKSCAALAPLPHTLLARSAGRY

SEQ ID NO: 16322 - protein, 19 aa, Brucella spp.
ERIAWPSPFDEAFAAIHAR

SEQ ID NO: 16323 - protein, 26 aa, Brucella spp.
HGRPFELLVPHILPGVRLLVLSNDGT

SEQ ID NO: 16324 - protein, 24 aa, Brucella spp.
SRLQPLPHQLLWDVGAGCGSIGIE

SEQ ID NO: 16325 - protein, 17 aa, Brucella spp.
LEAPDAIFIGGGVTDEG

SEQ ID NO: 16326 - protein, 20 aa, Brucella spp.
MRLFAWRQEFGGDLTRVGVA

SEQ ID NO: 16327 - protein, 18 aa, Brucella spp.
GSFDVWRQALPVTIYCGF

SEQ ID NO: 16328 - protein, 27 aa, Brucella spp.
ALADYELLELLLFRAIRRADTKPIAKA

SEQ ID NO: 16329 - protein, 18 aa, Brucella spp.
LKLVEAIAKRSARSTVME

SEQ ID NO: 16330 - protein, 18 aa, Brucella spp.
LYGPEAFEAMRKVCNLTA

SEQ ID NO: 16331 - protein, 19 aa, Brucella spp.
DAFPATLNYRGYTKSTCTS

SEQ ID NO: 16332 - protein, 20 aa, Brucella spp.
IVNIDVTYLLDGWHGDSSRM

SEQ ID NO: 16333 - protein, 18 aa, Brucella spp.
ERLLEVTYESLLRGIAAV

SEQ ID NO: 16334 - protein, 18 aa, Brucella spp.
VTYESLLRGIAAVKPGAK

SEQ ID NO: 16335 - protein, 17 aa, Brucella spp.
HGVGRLFHDAPNILHYG

SEQ ID NO: 16336 - protein, 25 aa, Brucella spp.
NEGVEIKEGMIFTIEPMINLGKPHV

SEQ ID NO: 16337 - protein, 17 aa, Brucella spp.
ERRYKRFLADVTLDDGR

SEQ ID NO: 16338 - protein, 20 aa, Brucella spp.
LTAPGSRVWLSFSDAPHRKY

SEQ ID NO: 16339 - protein, 18 aa, Brucella spp.
RAYVEVKNVHFIRTPGLA

SEQ ID NO: 16340 - protein, 19 aa, Brucella spp.
EVKNVHFIRTPGLAEFPDT

SEQ ID NO: 16341 - protein, 18 aa, Brucella spp.
ANFLLAAMAAAMLTACAG

SEQ ID NO: 16342 - protein, 24 aa, Brucella spp.
EGASRTGVYPKFGHLPKAATAQIT

SEQ ID NO: 16343 - protein, 23 aa, Brucella spp.
HLNKVLNLNCVYAASPPSPAHGD

SEQ ID NO: 16344 - protein, 17 aa, Brucella spp.
ANTALAIAQHHGISDLV

SEQ ID NO: 16345 - protein, 21 aa, Brucella spp.
KHYGVQHSIYIPDRIFEGYGP

SEQ ID NO: 16346 - protein, 20 aa, Brucella spp.
SIYIPDRIFEGYGPNPDAMR

SEQ ID NO: 16347 - protein, 25 aa, Brucella spp.
QQGHLCAAGVVFLALVQVAKILRAR

SEQ ID NO: 16348 - protein, 22 aa, Brucella spp.
PGPDLLSMLDLVALATVCDVVP

SEQ ID NO: 16349 - protein, 19 aa, Brucella spp.
RAFVVKGLLVARGQSNVGL

SEQ ID NO: 16350 - protein, 31 aa, Brucella spp.
ARIGEPLNAFHLGYLIGPRINAGGRIGDAGL

SEQ ID NO: 16351 - protein, 22 aa, Brucella spp.
DRWHPGIVGLLASRLKEKARRP

SEQ ID NO: 16352 - protein, 22 aa, Brucella spp.
EKARRPAFAIAFNANGVGSGSG

SEQ ID NO: 16353 - protein, 19 aa, Brucella spp.
AGITIERGNLGALRAYLEE

SEQ ID NO: 16354 - protein, 24 aa, Brucella spp.
FRAAEGDLGRFLFNNIGCSVHVAG

SEQ ID NO: 16355 - protein, 21 aa, Brucella spp.
LPKRLAAIFQLDRWLSILEMP

SEQ ID NO: 16356 - protein, 28 aa, Brucella spp.
EVSGHIKWFDVAKGYGFIVPDQPGLTDI

SEQ ID NO: 16357 - protein, 19 aa, Brucella spp.
VIVKWFNRTKGFGFLTRGE

SEQ ID NO: 16358 - protein, 24 aa, Brucella spp.
MMELRPGQVVLIRFGTGEKGLMAA

SEQ ID NO: 16359 - protein, 25 aa, Brucella spp.
TDFPKDRAMIFILGEMRRIVMWMQN

SEQ ID NO: 16360 - protein, 17 aa, Brucella spp.
SEVPAAYAVELLAGTVK

SEQ ID NO: 16361 - protein, 25 aa, Brucella spp.
QAGEGDPILLIHGFASSSLVNWVSP

SEQ ID NO: 16362 - protein, 24 aa, Brucella spp.
SSSLVNWVSPGWFRTLTEAGYRVI

SEQ ID NO: 16363 - protein, 22 aa, Brucella spp.
SKELVPVAAIERILQPVLVAVG

SEQ ID NO: 16364 - protein, 24 aa, Brucella spp.
ATRNDPVLGAFLYATILNQPSLEE

SEQ ID NO: 16365 - protein, 25 aa, Brucella spp.
EANPEWSHVLRVDIQAVYDRDPAYS

SEQ ID NO: 16366 - protein, 24 aa, Brucella spp.
SRFMDPVLYLKGFHAIQTHRLAHW

SEQ ID NO: 16367 - protein, 20 aa, Brucella spp.
DIHPAARLGSGLFLDHATGL

SEQ ID NO: 16368 - protein, 17 aa, Brucella spp.
IRQGVLIGAGAKILGNI

SEQ ID NO: 16369 - protein, 20 aa, Brucella spp.
GENAGFWFGAVLRGDNEPIT

SEQ ID NO: 16370 - protein, 27 aa, Brucella spp.
IMHTDIGFPLTIGAGCTIGHRAILHGC

SEQ ID NO: 16371 - protein, 17 aa, Brucella spp.
QDFEFMMNFALIPARFS

SEQ ID NO: 16372 - protein, 21 aa, Brucella spp.
FEFMMNFALIPARFSMASGFV

SEQ ID NO: 16373 - protein, 22 aa, Brucella spp.
GRIGAVRMILFWVFTSVVAGLT

SEQ ID NO: 16374 - protein, 19 aa, Brucella spp.
EGTVRLYGLHTVRAAVENP

SEQ ID NO: 16375 - protein, 31 aa, Brucella spp.
FARLEIGEADSLPFPVEIVDPRDIDKETGSE

SEQ ID NO: 16376 - protein, 24 aa, Brucella spp.
LSELRESPLLLVLDQVTDPHNVGA

SEQ ID NO: 16377 - protein, 17 aa, Brucella spp.
ELHTLGFQTIGLDSQGP

SEQ ID NO: 16378 - protein, 25 aa, Brucella spp.
KVDAERKFFPGYVLVRAKLTDSVFS

SEQ ID NO: 16379 - protein, 23 aa, Brucella spp.
RARLKVEVSIFGRATPVDLEYGQ

SEQ ID NO: 16380 - protein, 23 aa, Brucella spp.
EMEKGSPIPVLITYYQDKSFTFV

SEQ ID NO: 16381 - protein, 24 aa, Brucella spp.
RNKLYDLSAAIGLVKERAVAKFDE

SEQ ID NO: 16382 - protein, 17 aa, Brucella spp.
ETVEIAMNLGVDPRHAD

SEQ ID NO: 16383 - protein, 28 aa, Brucella spp.
VGAEELFEIVNGGKIEFDRCIATPDMMP

SEQ ID NO: 16384 - protein, 19 aa, Brucella spp.
LVGRLGKVLGPRGMMPNPK

SEQ ID NO: 16385 - protein, 19 aa, Brucella spp.
AGIIHAGIGKVSFDNAKLE

SEQ ID NO: 16386 - protein, 17 aa, Brucella spp.
FVAWLNGAFKESGSVVV

SEQ ID NO: 16387 - protein, 21 aa, Brucella spp.
FKESGSVVVAHYTGLTVAQMS

SEQ ID NO: 16388 - protein, 32 aa, Brucella spp.
VFKSVFPIQDFSGASMLEFVRYEFDPPKFDVD

SEQ ID NO: 16389 - protein, 28 aa, Brucella spp.
DLTYSAPLKVTLRLIVFDIDEDTGAKSI

SEQ ID NO: 16390 - protein, 24 aa, Brucella spp.
LFAARVIPYRGSWLDIEFDSKDIV

SEQ ID NO: 16391 - protein, 20 aa, Brucella spp.
RKLPATTLLMALGMDGEEIL

SEQ ID NO: 16392 - protein, 21 aa, Brucella spp.
SAERFKGMKIISDLVDADTGE

SEQ ID NO: 16393 - protein, 20 aa, Brucella spp.
EAMFHSLFFDSERYDLSAVG

SEQ ID NO: 16394 - protein, 19 aa, Brucella spp.
EDILAVVKMLVELRDGRGE

SEQ ID NO: 16395 - protein, 17 aa, Brucella spp.
AVREFFGSSQLSQFMDQ

SEQ ID NO: 16396 - protein, 20 aa, Brucella spp.
PNIGLINSLATFARVNKYGF

SEQ ID NO: 16397 - protein, 24 aa, Brucella spp.
LATFARVNKYGFIESPYRKVVDGK

SEQ ID NO: 16398 - protein, 27 aa, Brucella spp.
GDLALGRNVLVAFMPWNGYNYEDSILL

SEQ ID NO: 16399 - protein, 20 aa, Brucella spp.
AEVHPGDILVGKITPKGESP

SEQ ID NO: 16400 - protein, 22 aa, Brucella spp.
PMTPEEKLLRAIFGEKASDVRD

SEQ ID NO: 16401 - protein, 17 aa, Brucella spp.
GKVAAAGPKGFKKGTTI

SEQ ID NO: 16402 - protein, 24 aa, Brucella spp.
LMTEYPRSQWWQFAVEDEKLQGEL

SEQ ID NO: 16403 - protein, 18 aa, Brucella spp.
NVGQILETHLGWACAGMG

SEQ ID NO: 16404 - protein, 20 aa, Brucella spp.
LETHLGWACAGMGKKIGELL

SEQ ID NO: 16405 - protein, 21 aa, Brucella spp.
FDRQVTMGYIYMLKLHHLVDD

SEQ ID NO: 16406 - protein, 22 aa, Brucella spp.
FGEMEVWALEAYGAAYTLQEML

SEQ ID NO: 16407 - protein, 23 aa, Brucella spp.
DTFEAGIPESFNVLVKEMRSLGL

SEQ ID NO: 16408 - protein, 21 aa, Brucella spp.
SIASPEKILSWSYGEIKKPET

SEQ ID NO: 16409 - protein, 28 aa, Brucella spp.
FKPERDGLFCARIFGPIKDYECLCGKYK

SEQ ID NO: 16410 - protein, 22 aa, Brucella spp.
CEKCGVEVTLSRVRRERMGHIE

SEQ ID NO: 16411 - protein, 27 aa, Brucella spp.
GHIELAAPVAHIWFLKSLPSRIGTLLD

SEQ ID NO: 16412 - protein, 17 aa, Brucella spp.
LKSLPSRIGTLLDMTLK

SEQ ID NO: 16413 - protein, 21 aa, Brucella spp.
SLPSRIGTLLDMTLKDIERVL

SEQ ID NO: 16414 - protein, 23 aa, Brucella spp.
MTLKDIERVLYFENYIVTEPGLT

SEQ ID NO: 16415 - protein, 20 aa, Brucella spp.
AEAIYELLASMELEKIAADL

SEQ ID NO: 16416 - protein, 18 aa, Brucella spp.
KIVENFLESGNRPEWMIM

SEQ ID NO: 16417 - protein, 25 aa, Brucella spp.
SGNRPEWMIMKIVPVIPPDLRPLVP

SEQ ID NO: 16418 - protein, 26 aa, Brucella spp.
VPVIPPDLRPLVPLDGGRFATSDLND

SEQ ID NO: 16419 - protein, 20 aa, Brucella spp.
LKRLIELRAPGIIIRNEKRM

SEQ ID NO: 16420 - protein, 32 aa, Brucella spp.
HQCGLPKKMALELFKPFIYARLDAKGYSSTVK

SEQ ID NO: 16421 - protein, 17 aa, Brucella spp.
PTLHRLGIQAFEPTLIE

SEQ ID NO: 16422 - protein, 22 aa, Brucella spp.
DQMAVHVPLSLEAQLEARVLMM

SEQ ID NO: 16423 - protein, 21 aa, Brucella spp.
SQDMVLGLYYLSIVAEKEPGE

SEQ ID NO: 16424 - protein, 20 aa, Brucella spp.
KEPGEGMIFADMGELQHALE

SEQ ID NO: 16425 - protein, 24 aa, Brucella spp.
GELLPKNVNVPFDICNQEMTKKNI

SEQ ID NO: 16426 - protein, 19 aa, Brucella spp.
TVIFCDRIMQLGFAHACRA

SEQ ID NO: 16427 - protein, 19 aa, Brucella spp.
CDRIMQLGFAHACRAGISF

SEQ ID NO: 16428 - protein, 24 aa, Brucella spp.
LGFAHACRAGISFGKDDMVIPESK

SEQ ID NO: 16429 - protein, 18 aa, Brucella spp.
NFKEGLTVNEYFNSTHGA

SEQ ID NO: 16430 - protein, 17 aa, Brucella spp.
LTVNEYFNSTHGARKGL

SEQ ID NO: 16431 - protein, 24 aa, Brucella spp.
EVDCGAEIGLTMQPIVDAGQIVAS

SEQ ID NO: 16432 - protein, 19 aa, Brucella spp.
KAGIQSIRIRSALTCETRN

SEQ ID NO: 16433 - protein, 23 aa, Brucella spp.
PRGSDLKPAMVIKDKAGKILKLS

SEQ ID NO: 16434 - protein, 20 aa, Brucella spp.
VEYLIPKGKPFHLQDGDVIE

SEQ ID NO: 16435 - protein, 21 aa, Brucella spp.
AIKGVEALASYLVNEIQEVYR

SEQ ID NO: 16436 - protein, 20 aa, Brucella spp.
EIQEVYRLQGVLINDKHIEV

SEQ ID NO: 16437 - protein, 17 aa, Brucella spp.
LQTPSFISAASFQETTR

SEQ ID NO: 16438 - protein, 21 aa, Brucella spp.
LKENVIVGRLIPAGTGGMTNQ

SEQ ID NO: 16439 - protein, 26 aa, Brucella spp.
INPDPKFGDLVITKFMNAVMLHGKKS

SEQ ID NO: 16440 - protein, 20 aa, Brucella spp.
KSVAESIVYGALDAIEATAK

SEQ ID NO: 16441 - protein, 27 aa, Brucella spp.
VRPERRQALAIRWLINAARGRNETTMV

SEQ ID NO: 16442 - protein, 17 aa, Brucella spp.
DYRNFGIMAHIDAGKTT

SEQ ID NO: 16443 - protein, 20 aa, Brucella spp.
LGAVALPVQLPIGAENDFVG

SEQ ID NO: 16444 - protein, 24 aa, Brucella spp.
PIGAENDFVGVVDLIEMKALTWDG

SEQ ID NO: 16445 - protein, 29 aa, Brucella spp.
KGTIEVKFHPILCGTAFKNRGVQPLLDAV

SEQ ID NO: 16446 - protein, 24 aa, Brucella spp.
SSDEAPLSMLAFKIMNDPFVGSLT

SEQ ID NO: 16447 - protein, 25 aa, Brucella spp.
IMNDPFVGSLTFTRIYSGKLTKGVS

SEQ ID NO: 16448 - protein, 19 aa, Brucella spp.
DPLKPVILERMEFPDPVIE

SEQ ID NO: 16449 - protein, 21 aa, Brucella spp.
MGAGPLAGFPMLGVKATLIDG

SEQ ID NO: 16450 - protein, 21 aa, Brucella spp.
SVLAFEIASRAAFREGAQKAG

SEQ ID NO: 16451 - protein, 17 aa, Brucella spp.
IASRAAFREGAQKAGAQ

SEQ ID NO: 16452 - protein, 19 aa, Brucella spp.
VPLANMFGYVNSLRSMSQG

SEQ ID NO: 16453 - protein, 19 aa, Brucella spp.
VRGPIPLPTRIEKFTVNRS

SEQ ID NO: 16454 - protein, 18 aa, Brucella spp.
FAGVMKRHNFGGHRASHG

SEQ ID NO: 16455 - protein, 24 aa, Brucella spp.
RGAVPGSKGAWILVRDAVKASLPE

SEQ ID NO: 16456 - protein, 20 aa, Brucella spp.
PKKVRALGLRHALSAKAKAS

SEQ ID NO: 16457 - protein, 20 aa, Brucella spp.
AKASDLIIIDDLASADAKTK

SEQ ID NO: 16458 - protein, 22 aa, Brucella spp.
AKLGLENALLIGGAEIDANFQR

SEQ ID NO: 16459 - protein, 22 aa, Brucella spp.
EIKAAVEALFGVKVTAVNTAVC

SEQ ID NO: 16460 - protein, 18 aa, Brucella spp.
KGKVKRFRGLVGRQSDVK

SEQ ID NO: 16461 - protein, 23 aa, Brucella spp.
DPNRTAFIALIRYTDGELAYILA

SEQ ID NO: 16462 - protein, 24 aa, Brucella spp.
RYTDGELAYILAPQRLAVGDQVVA

SEQ ID NO: 16463 - protein, 18 aa, Brucella spp.
GLRLGVNRTWDSRWYANT

SEQ ID NO: 16464 - protein, 20 aa, Brucella spp.
RRAMKRAVQSAMRLGAEGIR

SEQ ID NO: 16465 - protein, 28 aa, Brucella spp.
EAKTAYGICGVKVWVFKGEILEHDPMAS

SEQ ID NO: 16466 - protein, 23 aa, Brucella spp.
HMKRAGRVWIRIFPDLPVTSKPT

SEQ ID NO: 16467 - protein, 22 aa, Brucella spp.
DYWACRVAPGRVMFELDGVPED

SEQ ID NO: 16468 - protein, 24 aa, Brucella spp.
DNKKEPIGTRIFGPVPRELRAKNH

SEQ ID NO: 16469 - protein, 26 aa, Brucella spp.
VMPKDEQALVSGINIVKRHQRQTQTQ

SEQ ID NO: 16470 - protein, 23 aa, Brucella spp.
EFLDRLITIALPRVRDFRGLNPK

SEQ ID NO: 16471 - protein, 29 aa, Brucella spp.
EIEIELKYYEGVPVIREITRVSKPGRRVY

SEQ ID NO: 16472 - protein, 17 aa, Brucella spp.
QGKNLQLSLGFSHEVVY

SEQ ID NO: 16473 - protein, 23 aa, Brucella spp.
KNLQLSLGFSHEVVYDVPAGITV

SEQ ID NO: 16474 - protein, 19 aa, Brucella spp.
FSHEVVYDVPAGITVAVPK

SEQ ID NO: 16475 - protein, 20 aa, Brucella spp.
VYDVPAGITVAVPKPTEIVV

SEQ ID NO: 16476 - protein, 28 aa, Brucella spp.
RAVKAGVKDVVFDRGAFIYHGRVKALAE

SEQ ID NO: 16477 - protein, 29 aa, Brucella spp.
RVAKVVKGGRRFGFAALVVVGDQKGRVGF

SEQ ID NO: 16478 - protein, 23 aa, Brucella spp.
EAAKRDMIFVPLRSGRTLHHDVE

SEQ ID NO: 16479 - protein, 23 aa, Brucella spp.
MHPKDIAAQRGIKYSTLQARRHD

SEQ ID NO: 16480 - protein, 24 aa, Brucella spp.
KSRSGVSINGFEGGQMPIYRRLPK

SEQ ID NO: 16481 - protein, 24 aa, Brucella spp.
PKRGFTNIFAKSFNVVSLGRIQAA

SEQ ID NO: 16482 - protein, 23 aa, Brucella spp.
SDGELKAKVAFEVAGASKAAVEK

SEQ ID NO: 16483 - protein, 26 aa, Brucella spp.
EELKKRIWFTLGALLVYRFGTYIPLP

SEQ ID NO: 16484 - protein, 21 aa, Brucella spp.
GALLVYRFGTYIPLPGINPDA

SEQ ID NO: 16485 - protein, 19 aa, Brucella spp.
ISGTLELGRTGALSTGLIL

SEQ ID NO: 16486 - protein, 20 aa, Brucella spp.
HGQPLYMLFYAALMAFFCFF

SEQ ID NO: 16487 - protein, 17 aa, Brucella spp.
MAFFCFFYTAIVFNPKD

SEQ ID NO: 16488 - protein, 23 aa, Brucella spp.
IVLVCLLPEFLISATGVPFYLGG

SEQ ID NO: 16489 - protein, 25 aa, Brucella spp.
RIDAPDCANGFILDGYPRTVPQAQA

SEQ ID NO: 16490 - protein, 18 aa, Brucella spp.
GKGLKLDAVIELKVDENA

SEQ ID NO: 16491 - protein, 20 aa, Brucella spp.
LKLDAVIELKVDENALVKRM

SEQ ID NO: 16492 - protein, 19 aa, Brucella spp.
ELKVDENALVKRMESRVAE

SEQ ID NO: 16493 - protein, 20 aa, Brucella spp.
AGTGELRIINGMAPVEEVTA

SEQ ID NO: 16494 - protein, 17 aa, Brucella spp.
PKFAREIVTKVGIADDR

SEQ ID NO: 16495 - protein, 24 aa, Brucella spp.
SMNIKRLMDLGCYRGLRHRRSLPV

SEQ ID NO: 16496 - protein, 25 aa, Brucella spp.
NAIAWSSAGAQGFKGSRKSTPFAAQ

SEQ ID NO: 16497 - protein, 18 aa, Brucella spp.
ESALRALQAAGFVITSIR

SEQ ID NO: 16498 - protein, 18 aa, Brucella spp.
ALQAAGFVITSIRDVTPI

SEQ ID NO: 16499 - protein, 26 aa, Brucella spp.
VVAEPLERGFGLTLGNALRRVLLSSL

SEQ ID NO: 16500 - protein, 22 aa, Brucella spp.
EGAEIRMEFTVNTGKGYVPADC

SEQ ID NO: 16501 - protein, 20 aa, Brucella spp.
ILQDQLSIFVNFEEPQKEAP

SEQ ID NO: 16502 - protein, 18 aa, Brucella spp.
LAFNPALLKKVDELELSV

SEQ ID NO: 16503 - protein, 32 aa, Brucella spp.
NEIKEVLASMGLHLGMEIPAWPPENIEDLAKR

SEQ ID NO: 16504 - protein, 17 aa, Brucella spp.
AIRDVRLVAKLFDTLAA

SEQ ID NO: 16505 - protein, 18 aa, Brucella spp.
RLVAKLFDTLAARYATRN

SEQ ID NO: 16506 - protein, 19 aa, Brucella spp.
GGYIRIMKAGFRAGDNAPL

SEQ ID NO: 16507 - protein, 17 aa, Brucella spp.
GDNAPLAVVEFVERDVD

SEQ ID NO: 16508 - protein, 19 aa, Brucella spp.
LSDGREFESRILLRDETTD

SEQ ID NO: 16509 - protein, 21 aa, Brucella spp.
LKIEAKQQFPVLALGNSDEVE

SEQ ID NO: 16510 - protein, 20 aa, Brucella spp.
EVGDLVLAIGNPFGVGQTVT

SEQ ID NO: 16511 - protein, 23 aa, Brucella spp.
GSVGIGFAIPSNMVRAVVDAALQ

SEQ ID NO: 16512 - protein, 18 aa, Brucella spp.
KTGIALICATFLAGCTTD

SEQ ID NO: 16513 - protein, 23 aa, Brucella spp.
RIILNMPSNITFDTDQDQVKSQF

SEQ ID NO: 16514 - protein, 20 aa, Brucella spp.
YPTLNSVAIVLRKFDKTLVD

SEQ ID NO: 16515 - protein, 19 aa, Brucella spp.
QGIDPRRFAVIGYGASQPI

SEQ ID NO: 16516 - protein, 18 aa, Brucella spp.
RFAVIGYGASQPIASNAT

SEQ ID NO: 16517 - protein, 23 aa, Brucella spp.
EHALDPVYARKLGVDLENLLISQ

SEQ ID NO: 16518 - protein, 18 aa, Brucella spp.
MGDSLPGLQARLMSQALR

SEQ ID NO: 16519 - protein, 18 aa, Brucella spp.
GLQARLMSQALRKLTGSI

SEQ ID NO: 16520 - protein, 20 aa, Brucella spp.
RSNCMVIFINQIRMKIGVMF

SEQ ID NO: 16521 - protein, 21 aa, Brucella spp.
FINQIRMKIGVMFGSPETTTG

SEQ ID NO: 16522 - protein, 17 aa, Brucella spp.
MKIGVMFGSPETTTGGN

SEQ ID NO: 16523 - protein, 20 aa, Brucella spp.
GGNALKFYASVRLDIRRIGS

SEQ ID NO: 16524 - protein, 24 aa, Brucella spp.
PPFKQVEFDIMYGAGVSKVGELVD

SEQ ID NO: 16525 - protein, 25 aa, Brucella spp.
HHTFFEMLGNFSFGDYFKEDAISFA

SEQ ID NO: 16526 - protein, 27 aa, Brucella spp.
FGDYFKEDAISFAWNLITREFGLPKDK

SEQ ID NO: 16527 - protein, 18 aa, Brucella spp.
PCSEIFYDHGDHIWGGPP

SEQ ID NO: 16528 - protein, 26 aa, Brucella spp.
EEDGDRFIEIWNLVFMQFEQQTPELR

SEQ ID NO: 16529 - protein, 19 aa, Brucella spp.
PSIDTGMGLERIAAVLQGV

SEQ ID NO: 16530 - protein, 23 aa, Brucella spp.
HDNYDIDLFKALIRASEEATGVK

SEQ ID NO: 16531 - protein, 30 aa, Brucella spp.
AQLLGAKEPLMWRLLPALIREMGQAYPELI

SEQ ID NO: 16532 - protein, 18 aa, Brucella spp.
QAYPELIRAESLISETLK

SEQ ID NO: 16533 - protein, 17 aa, Brucella spp.
IRAESLISETLKLEETR

SEQ ID NO: 16534 - protein, 28 aa, Brucella spp.
DGETAFKLYDTYGFPLDLTQDALRQRGI

SEQ ID NO: 16535 - protein, 18 aa, Brucella spp.
ATETIWFGIKDKVGATEF

SEQ ID NO: 16536 - protein, 17 aa, Brucella spp.
GVIASLVRDGVEVPSVR

SEQ ID NO: 16537 - protein, 18 aa, Brucella spp.
LEALTGEAARLYLEEQDE

SEQ ID NO: 16538 - protein, 17 aa, Brucella spp.
NGVNFLGKIVTGVSPRD

SEQ ID NO: 16539 - protein, 23 aa, Brucella spp.
ARVEEFKLKKMWKSPNGTIRNIL

SEQ ID NO: 16540 - protein, 23 aa, Brucella spp.
GTIRNILGGVIFREPIICKNVPR

SEQ ID NO: 16541 - protein, 26 aa, Brucella spp.
ICKNVPRLVPGWTQPIIVGRHAFGDQ

SEQ ID NO: 16542 - protein, 23 aa, Brucella spp.
TDFKFPGKGTLTIKFVGEDGQTI

SEQ ID NO: 16543 - protein, 26 aa, Brucella spp.
MVASALKWSGGYVWACKNYDGDVQSD

SEQ ID NO: 16544 - protein, 24 aa, Brucella spp.
TSTNSIASIFAWTRGLAHRAKLDN

SEQ ID NO: 16545 - protein, 20 aa, Brucella spp.
KDLALLIGPDQPWLSTTGFL

SEQ ID NO: 16546 - protein, 25 aa, Brucella spp.
VTSVRLENFFWWTLEDIAARDNLTV

SEQ ID NO: 16547 - protein, 25 aa, Brucella spp.
FLRVCCGRYLSLQLNGFVPTEKTTP

SEQ ID NO: 16548 - protein, 17 aa, Brucella spp.
ILAEGPAIILVNPQLPE

SEQ ID NO: 16549 - protein, 18 aa, Brucella spp.
AIADLNFVYATTARERDG

SEQ ID NO: 16550 - protein, 20 aa, Brucella spp.
KTGEKTGILFGRERFGLSNE

SEQ ID NO: 16551 - protein, 23 aa, Brucella spp.
ADELLTFPVNPAFASLNIAQAVL

SEQ ID NO: 16552 - protein, 19 aa, Brucella spp.
IAQAVLLMSYEWMKSGLEN

SEQ ID NO: 16553 - protein, 17 aa, Brucella spp.
LLMSYEWMKSGLENQTD

SEQ ID NO: 16554 - protein, 23 aa, Brucella spp.
FASAELKLLRGVVTSLDVFTPKK

SEQ ID NO: 16555 - protein, 20 aa, Brucella spp.
RVVMPDRRFVYIADDAGFPY

SEQ ID NO: 16556 - protein, 24 aa, Brucella spp.
EEALKRRIIELFGEFIANYDPEIA

SEQ ID NO: 16557 - protein, 35 aa, Brucella spp.
VLACTHYPFLVNVLRRLAPWPVDWLDPAEAIARRM

SEQ ID NO: 16558 - protein, 22 aa, Brucella spp.
FAVAQAPTFFRIGTGGTAGTYY

SEQ ID NO: 16559 - protein, 25 aa, Brucella spp.
GKVEDLRLLATLYPETIHIVARKDA

SEQ ID NO: 16560 - protein, 24 aa, Brucella spp.
RLKDGALDAYFFVGGYPTGAISEL

SEQ ID NO: 16561 - protein, 24 aa, Brucella spp.
GAISELAISNGISLVPISGPEADK

SEQ ID NO: 16562 - protein, 19 aa, Brucella spp.
KILEKYSFFSKDVVPAGAY

SEQ ID NO: 16563 - protein, 21 aa, Brucella spp.
VAETPTLAVAAQWVTSAKQPD

SEQ ID NO: 16564 - protein, 17 aa, Brucella spp.
LAVAAQWVTSAKQPDDL

SEQ ID NO: 16565 - protein, 28 aa, Brucella spp.
MIHRGIHLAFVLGLVFLVFPFSRKGYDE

SEQ ID NO: 16566 - protein, 17 aa, Brucella spp.
AKPSLLRPLGISVIDWG

SEQ ID NO: 16567 - protein, 18 aa, Brucella spp.
LEATRRSVGWPLPIISVL

SEQ ID NO: 16568 - protein, 22 aa, Brucella spp.
RRSVGWPLPIISVLFMLYALYG

SEQ ID NO: 16569 - protein, 17 aa, Brucella spp.
FVLFGVFATRIGLGQLF

SEQ ID NO: 16570 - protein, 24 aa, Brucella spp.
ALKRDWPTIIPLVVLIAVLLSGYT

SEQ ID NO: 16571 - protein, 24 aa, Brucella spp.
LGVEPIVAHFFVFYYGVLADITPP

SEQ ID NO: 16572 - protein, 22 aa, Brucella spp.
SNFNWPDFFIAFFGCVIGITAL

SEQ ID NO: 16573 - protein, 17 aa, Brucella spp.
WENVLLIFAAMLLVAPE

SEQ ID NO: 16574 - protein, 17 aa, Brucella spp.
NVLLIFAAMLLVAPEIY

SEQ ID NO: 16575 - protein, 21 aa, Brucella spp.
SSVGGFKLYMVEFVTEGEERI

SEQ ID NO: 16576 - protein, 18 aa, Brucella spp.
RRAAIKLGDAMGMACAEC

SEQ ID NO: 16577 - protein, 18 aa, Brucella spp.
HTPEGIDVKPLYTQDDLE

SEQ ID NO: 16578 - protein, 18 aa, Brucella spp.
GIDVKPLYTQDDLEGIGH

SEQ ID NO: 16579 - protein, 23 aa, Brucella spp.
EGIGHLGTLPGFEPFLRGPRATM

SEQ ID NO: 16580 - protein, 27 aa, Brucella spp.
PRATMYAGRPWTIRQYAGFSTAEESNA

SEQ ID NO: 16581 - protein, 18 aa, Brucella spp.
VSVAFDLATHRGYDSDHP

SEQ ID NO: 16582 - protein, 23 aa, Brucella spp.
MNGAVIPILANFIVAGEEQGVPR

SEQ ID NO: 16583 - protein, 23 aa, Brucella spp.
TAQEMPKFNSISISGYHMQEAGA

SEQ ID NO: 16584 - protein, 46 aa, Brucella spp.
LNVDDFAGRLSFFFAIGMNFFMEIAKLRAARLLWSRIMKEFDPKKP

SEQ ID NO: 16585 - protein, 21 aa, Brucella spp.
EAIALPTEFSARIARNTQLIL

SEQ ID NO: 16586 - protein, 24 aa, Brucella spp.
GDIGFEVLAGPLFQTPDEAADMAI

SEQ ID NO: 16587 - protein, 17 aa, Brucella spp.
GVVPRQDYQYLFDHGVA

SEQ ID NO: 16588 - protein, 24 aa, Brucella spp.
YQYLFDHGVAAVFGPGTNVLDCAR

SEQ ID NO: 16589 - protein, 18 aa, Brucella spp.
IGADAVHPGYGFLSENPR

SEQ ID NO: 16590 - protein, 18 aa, Brucella spp.
VHPGYGFLSENPRFAEAL

SEQ ID NO: 16591 - protein, 26 aa, Brucella spp.
EAVRIAGSIGYPVMIKASAGGGGKGM

SEQ ID NO: 16592 - protein, 20 aa, Brucella spp.
TELITGIDLVEEMIRVASGE

SEQ ID NO: 16593 - protein, 18 aa, Brucella spp.
ASGEKLRFAQADVKLNGW

SEQ ID NO: 16594 - protein, 28 aa, Brucella spp.
RLYAEDPYRNFLPSIGRLTRYRPPVEGR

SEQ ID NO: 16595 - protein, 17 aa, Brucella spp.
IGHNLPFLSAVMDHPRF

SEQ ID NO: 16596 - protein, 22 aa, Brucella spp.
DHPRFREGALTTAFIAEEYPDG

SEQ ID NO: 16597 - protein, 26 aa, Brucella spp.
VKVSRSGTGWRLRWRGMDVVAHVRKP

SEQ ID NO: 16598 - protein, 25 aa, Brucella spp.
KPRVAELAKLMPVKLPPDTSKMLLC

SEQ ID NO: 16599 - protein, 22 aa, Brucella spp.
RCEDGVAYVIGFLEANYGLSPH

SEQ ID NO: 16600 - protein, 19 aa, Brucella spp.
SIEDLAAWIDFRLAEQRAA

SEQ ID NO: 16601 - protein, 24 aa, Brucella spp.
DELLEGSSLYWVIKGNVQCRQRLL

SEQ ID NO: 16602 - protein, 24 aa, Brucella spp.
IVPTEWQPRRAFQGWRYLNENESP

SEQ ID NO: 16603 - protein, 20 aa, Brucella spp.
ERALHQALTIANERHHEYAT

SEQ ID NO: 16604 - protein, 23 aa, Brucella spp.
AVMRACNVDLDYLKHIVTDYIDR

SEQ ID NO: 16605 - protein, 21 aa, Brucella spp.
DEVTGANVLVAIFAERESHAA

SEQ ID NO: 16606 - protein, 18 aa, Brucella spp.
QVPDALADATIFSLDMGT

SEQ ID NO: 16607 - protein, 23 aa, Brucella spp.
TIFSLDMGTLLAGTRYRGDFEER

SEQ ID NO: 16608 - protein, 28 aa, Brucella spp.
QVVKELEEFPGAVLFIDEIHTVIGAGAT

SEQ ID NO: 16609 - protein, 19 aa, Brucella spp.
PSIPDTIEIMKGLKPYFED

SEQ ID NO: 16610 - protein, 17 aa, Brucella spp.
SASIKLARAGLREPDKP

SEQ ID NO: 16611 - protein, 17 aa, Brucella spp.
VELLRFDMSEYMERHTV

SEQ ID NO: 16612 - protein, 18 aa, Brucella spp.
TVSRLIGAPPGYVGFDQG

SEQ ID NO: 16613 - protein, 24 aa, Brucella spp.
IEKAHPDLFNILLQVMDHGALTDH

SEQ ID NO: 16614 - protein, 18 aa, Brucella spp.
GKKIDFRNVILIMTTNAG

SEQ ID NO: 16615 - protein, 25 aa, Brucella spp.
FRNRLDAIIPFGPLPVPVIHQVVQK

SEQ ID NO: 16616 - protein, 26 aa, Brucella spp.
RGVTFELTDAAIAWLADKGYDERMGA

SEQ ID NO: 16617 - protein, 20 aa, Brucella spp.
KPLADEVLFGKLKHGGTVRV

SEQ ID NO: 16618 - protein, 21 aa, Brucella spp.
FDHGWADAFERAGGRYYPKFQ

SEQ ID NO: 16619 - protein, 20 aa, Brucella spp.
GRYYPKFQAAVPFTPATGPR

SEQ ID NO: 16620 - protein, 18 aa, Brucella spp.
NHAVRLALAGGLRELADQ

SEQ ID NO: 16621 - protein, 17 aa, Brucella spp.
IPALEKAGFLHRTDQQF

SEQ ID NO: 16622 - protein, 20 aa, Brucella spp.
AEGIEIDWLTGHDLTEAIWD

SEQ ID NO: 16623 - protein, 18 aa, Brucella spp.
AIWDDFFSFYMDTGSRKW

SEQ ID NO: 16624 - protein, 17 aa, Brucella spp.
RHWGCIEDHPFLHFEVC

SEQ ID NO: 16625 - protein, 19 aa, Brucella spp.
CIEDHPFLHFEVCYHQAID

SEQ ID NO: 16626 - protein, 18 aa, Brucella spp.
LHFEVCYHQAIDFAIEHK

SEQ ID NO: 16627 - protein, 20 aa, Brucella spp.
YHQAIDFAIEHKLRVVEAGA

SEQ ID NO: 16628 - protein, 18 aa, Brucella spp.
FAIEHKLRVVEAGAQGEH

SEQ ID NO: 16629 - protein, 17 aa, Brucella spp.
GRVPLVIELKGIEGRDD

SEQ ID NO: 16630 - protein, 18 aa, Brucella spp.
EAAIMSFDHHLIRRFTAD

SEQ ID NO: 16631 - protein, 23 aa, Brucella spp.
VRERLQIPVISWTVRDREMQKYS

SEQ ID NO: 16632 - protein, 20 aa, Brucella spp.
SGATVFMWAGFAGAASAASA

SEQ ID NO: 16633 - protein, 19 aa, Brucella spp.
KSGISGLTGRMVYEFNGSA

SEQ ID NO: 16634 - protein, 20 aa, Brucella spp.
EGYTTNFRFVTRVDMDEQPQ

SEQ ID NO: 16635 - protein, 25 aa, Brucella spp.
KFSKDQVWPVTIAYFDDKEQQDGMP

SEQ ID NO: 16636 - protein, 17 aa, Brucella spp.
QDGMPIYRINFKLYRNG

SEQ ID NO: 16637 - protein, 19 aa, Brucella spp.
PIYRINFKLYRNGITRDLT

SEQ ID NO: 16638 - protein, 19 aa, Brucella spp.
KLYRNGITRDLTMDYGDFS

SEQ ID NO: 16639 - protein, 19 aa, Brucella spp.
WNPKMAPFIYGERNNIHIL

SEQ ID NO: 16640 - protein, 17 aa, Brucella spp.
FIYGERNNIHILDLSQT

SEQ ID NO: 16641 - protein, 18 aa, Brucella spp.
LSQTVPLLNSALKVVSDT

SEQ ID NO: 16642 - protein, 22 aa, Brucella spp.
YVNARWLGGMMTNWKTISNSIQ

SEQ ID NO: 16643 - protein, 19 aa, Brucella spp.
MGSVPDLMFIIDTNKEAIA

SEQ ID NO: 16644 - protein, 19 aa, Brucella spp.
AKRLGIPVVAVIDSNCDPD

SEQ ID NO: 16645 - protein, 22 aa, Brucella spp.
AARAIALYCDLIARAALDGIAR

SEQ ID NO: 16646 - protein, 24 aa, Brucella spp.
ATEGKIEAAVDWLRAKGIAKADKK

SEQ ID NO: 16647 - protein, 21 aa, Brucella spp.
IGENISFRRSAALSVPQGVVA

SEQ ID NO: 16648 - protein, 23 aa, Brucella spp.
ADGLGKLGVLVAIETAGDAEAAQ

SEQ ID NO: 16649 - protein, 19 aa, Brucella spp.
EAAQAFGRQVAMHVAAVNP

SEQ ID NO: 16650 - protein, 18 aa, Brucella spp.
EREKAIFIDQARQSGKPD

SEQ ID NO: 16651 - protein, 25 aa, Brucella spp.
RKFYEEVVLLSQAFVINPDLTVEAA

SEQ ID NO: 16652 - protein, 18 aa, Brucella spp.
VINPDLTVEAALKDAEKA

SEQ ID NO: 16653 - protein, 17 aa, Brucella spp.
GAPAKITGFARIALGEG

SEQ ID NO: 16654 - protein, 21 aa, Brucella spp.
KITGFARIALGEGIEKEESDF

SEQ ID NO: 16655 - protein, 25 aa, Brucella spp.
IANDIKQARALGVEVGVVIGGGNIF

SEQ ID NO: 16656 - protein, 19 aa, Brucella spp.
VEVGVVIGGGNIFRGVAVA

SEQ ID NO: 16657 - protein, 17 aa, Brucella spp.
AMPEICESFSQRQATAY

SEQ ID NO: 16658 - protein, 18 aa, Brucella spp.
KVVIFAGGTGNPFFTTDS

SEQ ID NO: 16659 - protein, 22 aa, Brucella spp.
LARENNILIIVYSIHENGGLAD

SEQ ID NO: 16660 - protein, 20 aa, Brucella spp.
ASLLEPITIEAYGSTMPINQ

SEQ ID NO: 16661 - protein, 22 aa, Brucella spp.
ISVPESRMLSVSVWDKSMVGAV

SEQ ID NO: 16662 - protein, 19 aa, Brucella spp.
RLFGWAWLIVTGILLILDR

SEQ ID NO: 16663 - protein, 18 aa, Brucella spp.
RGALLTIGFLVAGCAILL

SEQ ID NO: 16664 - protein, 18 aa, Brucella spp.
GDEPFGFTTIVFLFAVVW

SEQ ID NO: 16665 - protein, 25 aa, Brucella spp.
IDAAVKRLFAMGLFSDVRIHQSGST

SEQ ID NO: 16666 - protein, 17 aa, Brucella spp.
RSVVNNVLFQGNKKIKD

SEQ ID NO: 16667 - protein, 20 aa, Brucella spp.
IANIEFVGNQAFSGRRLRDV

SEQ ID NO: 16668 - protein, 18 aa, Brucella spp.
FVGNQAFSGRRLRDVIST

SEQ ID NO: 16669 - protein, 20 aa, Brucella spp.
RRLEVLDFFQTVNISTAPGS

SEQ ID NO: 16670 - protein, 31 aa, Brucella spp.
GLSFTEPYFLGYRLSAGFDVFRRSYRVNDDY

SEQ ID NO: 16671 - protein, 29 aa, Brucella spp.
GTIRFGLPITDNFSAGIAYSLVQEKYDLF

SEQ ID NO: 16672 - protein, 17 aa, Brucella spp.
AGIAYSLVQEKYDLFRG

SEQ ID NO: 16673 - protein, 20 aa, Brucella spp.
FGDDGVRIFDLFKNSSDIIR

SEQ ID NO: 16674 - protein, 17 aa, Brucella spp.
VRIFDLFKNSSDIIRGF

SEQ ID NO: 16675 - protein, 25 aa, Brucella spp.
FKNSSDIIRGFKFNGIGPYQDAKNG

SEQ ID NO: 16676 - protein, 24 aa, Brucella spp.
SGTAEVQFPMPVLPESLGVRGAFF

SEQ ID NO: 16677 - protein, 21 aa, Brucella spp.
PVLPESLGVRGAFFADAATLY

SEQ ID NO: 16678 - protein, 38 aa, Brucella spp.
KKLRASVGVSLMWASPFGPLRFDYAFPVAKADTDKVQN

SEQ ID NO: 16679 - protein, 19 aa, Brucella spp.
PSRELTIGDVADFTGASLR

SEQ ID NO: 16680 - protein, 26 aa, Brucella spp.
PHRDFSAVGRMLFPASVRPESWLGET

SEQ ID NO: 16681 - protein, 23 aa, Brucella spp.
YIAPGVSVQCAFIGNNVSLHPGV

SEQ ID NO: 16682 - protein, 36 aa, Brucella spp.
NDIPDGERWGGIPARPIKQWFRDIANIRSIGQSRKD

SEQ ID NO: 16683 - protein, 24 aa, Brucella spp.
LAVLPHRYPFLLIDRIVDIDGDVS

SEQ ID NO: 16684 - protein, 18 aa, Brucella spp.
NPIMPGVLIVEAMAQTAG

SEQ ID NO: 16685 - protein, 23 aa, Brucella spp.
VSDLIPYGMAIGVHAHLGGLNII

SEQ ID NO: 16686 - protein, 23 aa, Brucella spp.
VHAHLGGLNIIGMKRSGMERKEI

SEQ ID NO: 16687 - protein, 25 aa, Brucella spp.
IHNLRHAVRMLFDRTKPIRQRAQDV

SEQ ID NO: 16688 - protein, 22 aa, Brucella spp.
IPIVKYIAPSVWAWRPQRARAM

SEQ ID NO: 16689 - protein, 18 aa, Brucella spp.
VVLPTLPRIEAMVRDLSR

SEQ ID NO: 16690 - protein, 27 aa, Brucella spp.
LALARIPSVLSYKADWFARKFLMPKIT

SEQ ID NO: 16691 - protein, 26 aa, Brucella spp.
ARKFLMPKITIWSAALPNIIVDEPVV

SEQ ID NO: 16692 - protein, 17 aa, Brucella spp.
PVVPEYFNEFVRPGMLA

SEQ ID NO: 16693 - protein, 18 aa, Brucella spp.
FVRPGMLARNLERIMRPG

SEQ ID NO: 16694 - protein, 17 aa, Brucella spp.
GDEGVLLYRGYPIDQLA

SEQ ID NO: 16695 - protein, 18 aa, Brucella spp.
VLLYRGYPIDQLAEHGDF

SEQ ID NO: 16696 - protein, 22 aa, Brucella spp.
GDFLETCYLLLYGELPTATQKA

SEQ ID NO: 16697 - protein, 19 aa, Brucella spp.
VMVGCLGAMSAFYHDSTDI

SEQ ID NO: 16698 - protein, 23 aa, Brucella spp.
AMAYKYHIGQPFVYPKNDLDFAS

SEQ ID NO: 16699 - protein, 17 aa, Brucella spp.
FRLMGFGHRVYKNYDPR

SEQ ID NO: 16700 - protein, 21 aa, Brucella spp.
LYPNIDFYSGITLKALGFPTE

SEQ ID NO: 16701 - protein, 33 aa, Brucella spp.
ALGFPTEMFTVLFALARTVGWVAQWKEMIEDPQ

SEQ ID NO: 16702 - protein, 24 aa, Brucella spp.
IGGARTALFNWLYAKHCGGKMLLR

SEQ ID NO: 16703 - protein, 23 aa, Brucella spp.
AAILDGLTWLGLDWDGEAISQFE

SEQ ID NO: 16704 - protein, 20 aa, Brucella spp.
FPNKDLDDFIILRSDGTPTY

SEQ ID NO: 16705 - protein, 18 aa, Brucella spp.
PQMSHIPLIHGADGAKLS

SEQ ID NO: 16706 - protein, 19 aa, Brucella spp.
RHGALGVDAYRAIGYLPAA

SEQ ID NO: 16707 - protein, 17 aa, Brucella spp.
VDAYRAIGYLPAALRNY

SEQ ID NO: 16708 - protein, 24 aa, Brucella spp.
LPAALRNYLVRLGWSHGDDEIMST

SEQ ID NO: 16709 - protein, 18 aa, Brucella spp.
AARFDFQKLEAINGLYMR

SEQ ID NO: 16710 - protein, 21 aa, Brucella spp.
FQKLEAINGLYMRSSDDQALF

SEQ ID NO: 16711 - protein, 24 aa, Brucella spp.
TLVELADGAKFIFASRPLALDEKA

SEQ ID NO: 16712 - protein, 22 aa, Brucella spp.
RRIPEFLMPHIVNGQARRVPNL

SEQ ID NO: 16713 - protein, 22 aa, Brucella spp.
VPNLKNLLDFGWRSCSIGSTIC

SEQ ID NO: 16714 - protein, 18 aa, Brucella spp.
ERLKETGIPPSFDEMKEA

SEQ ID NO: 16715 - protein, 25 aa, Brucella spp.
LEVLRLPDSIAPGLSPQKKFAPSVI

SEQ ID NO: 16716 - protein, 18 aa, Brucella spp.
PATVSVPVMGRIAAGVPI

SEQ ID NO: 16717 - protein, 19 aa, Brucella spp.
VPVMGRIAAGVPISAIQNQ

SEQ ID NO: 16718 - protein, 24 aa, Brucella spp.
IAPEEITYPLELTVIGESAAGKRF

SEQ ID NO: 16719 - protein, 21 aa, Brucella spp.
LRKGEAIRIFTGAPMPENADS

SEQ ID NO: 16720 - protein, 20 aa, Brucella spp.
KRLIILHGLDKGRHIRRAGL

SEQ ID NO: 16721 - protein, 19 aa, Brucella spp.
HARLPVFTRPRVAILATGD

SEQ ID NO: 16722 - protein, 21 aa, Brucella spp.
LEDGIDMLVTIGGASVGDRDF

SEQ ID NO: 16723 - protein, 25 aa, Brucella spp.
GALRNCGVALDFWKIAMRPGKPLMY

SEQ ID NO: 16724 - protein, 25 aa, Brucella spp.
PVSSLVCSLLFLRPLVAKLSGLALK

SEQ ID NO: 16725 - protein, 19 aa, Brucella spp.
VIGTARLAGIMAAKRTSDL

SEQ ID NO: 16726 - protein, 24 aa, Brucella spp.
TSDLIPLCHPLMLTKVAVEIEPDE

SEQ ID NO: 16727 - protein, 20 aa, Brucella spp.
VDRHMEIGSIRVIEKSGGKS

SEQ ID NO: 16728 - protein, 23 aa, Brucella spp.
CSLPALRKDFLFDPYQVYEARSW

SEQ ID NO: 16729 - protein, 18 aa, Brucella spp.
FDPYQVYEARSWGADCIL

SEQ ID NO: 16730 - protein, 24 aa, Brucella spp.
EARSWGADCILIIMASVDDDLAKE

SEQ ID NO: 16731 - protein, 21 aa, Brucella spp.
EMERALKLSSRLLGVNNRNLR

SEQ ID NO: 16732 - protein, 19 aa, Brucella spp.
LRLEKSGIGTFLIGESLMR

SEQ ID NO: 16733 - protein, 21 aa, Brucella spp.
PLGDAKAAFDIMMSGQATPSQ

SEQ ID NO: 16734 - protein, 20 aa, Brucella spp.
PSQIGGFLMALRVRGETVPE

SEQ ID NO: 16735 - protein, 17 aa, Brucella spp.
MIPVIAPDDAMDIVGTG

SEQ ID NO: 16736 - protein, 24 aa, Brucella spp.
RSISEAGLGFMFAPMHHSAMRHVG

SEQ ID NO: 16737 - protein, 19 aa, Brucella spp.
VELGTRTIFNLLGPLSNPA

SEQ ID NO: 16738 - protein, 27 aa, Brucella spp.
SVKRQLVGVFAPQWLEPLAHVLKELGS

SEQ ID NO: 16739 - protein, 24 aa, Brucella spp.
HVLKELGSETAWVVYGDGLDEMTT

SEQ ID NO: 16740 - protein, 20 aa, Brucella spp.
HLLIVLALVGVVLIQRSEGG

SEQ ID NO: 16741 - protein, 25 aa, Brucella spp.
NALTRTTAILAIGFFATSLLLGIMA

SEQ ID NO: 16742 - protein, 23 aa, Brucella spp.
IGFFATSLLLGIMARYGERPTDI

SEQ ID NO: 16743 - protein, 20 aa, Brucella spp.
DIEAMPFLEAIRQLGNELPR

SEQ ID NO: 16744 - protein, 24 aa, Brucella spp.
NELPRGTAVYIHLTLMPYIPAAGE

SEQ ID NO: 16745 - protein, 20 aa, Brucella spp.
LRSIGIAPDILLVRADREIP

SEQ ID NO: 16746 - protein, 22 aa, Brucella spp.
GLDSEVLSAFGIDPAPKPRMDR

SEQ ID NO: 16747 - protein, 18 aa, Brucella spp.
VKVNLDWIEAEVFESEDP

SEQ ID NO: 16748 - protein, 23 aa, Brucella spp.
LEKVHGILVPGGFGERGAEGKIL

SEQ ID NO: 16749 - protein, 28 aa, Brucella spp.
FARERKVPYFGICFGMQMACIEAARNLV

SEQ ID NO: 16750 - protein, 18 aa, Brucella spp.
VGLMTEWLKGNMLEKRAA

SEQ ID NO: 16751 - protein, 22 aa, Brucella spp.
YKDRLEAAGLNFAGMSPDGVLP

SEQ ID NO: 16752 - protein, 21 aa, Brucella spp.
EYADHPWFIGVQYHPELKSRP

SEQ ID NO: 16753 - protein, 22 aa, Brucella spp.
SRPFEPHPLFASFIEAAIEQSR

SEQ ID NO: 16754 - protein, 21 aa, Brucella spp.
MTDKLGIGLVYKSSFDKANRT

SEQ ID NO: 16755 - protein, 21 aa, Brucella spp.
LKKEYGFPVLTDIHTEEQCAA

SEQ ID NO: 16756 - protein, 25 aa, Brucella spp.
APVVDVLQIPAFLCRQTDLLIAAAR

SEQ ID NO: 16757 - protein, 17 aa, Brucella spp.
QFLAPWDMKNVLAKITE

SEQ ID NO: 16758 - protein, 19 aa, Brucella spp.
TERGVSFGYNTLVSDMRAL

SEQ ID NO: 16759 - protein, 21 aa, Brucella spp.
RALPIMAGLGAPVIFDATHSV

SEQ ID NO: 16760 - protein, 18 aa, Brucella spp.
VVNGKIFDAIAGMDAESQ

SEQ ID NO: 16761 - protein, 22 aa, Brucella spp.
QASGLPLYRYVGGTNAHVLPVP

SEQ ID NO: 16762 - protein, 19 aa, Brucella spp.
HVLPVPMMNIINGGAHADN

SEQ ID NO: 16763 - protein, 23 aa, Brucella spp.
DNPIDFQEFMILPVGATSIREAV

SEQ ID NO: 16764 - protein, 18 aa, Brucella spp.
KAGFKPGEDIALGLDCAA

SEQ ID NO: 16765 - protein, 20 aa, Brucella spp.
FKPGEDIALGLDCAATEFFK

SEQ ID NO: 16766 - protein, 17 aa, Brucella spp.
LGLDCAATEFFKDGNYV

SEQ ID NO: 16767 - protein, 27 aa, Brucella spp.
MAEDDWEGWKYLTDLIGNKCQLVGDDL

SEQ ID NO: 16768 - protein, 19 aa, Brucella spp.
LRDGIRLGVANSILVKVNQ

SEQ ID NO: 16769 - protein, 17 aa, Brucella spp.
LGVANSILVKVNQIGSL

SEQ ID NO: 16770 - protein, 26 aa, Brucella spp.
QELEAYREMLLIRRFEEKAGQLYGMG

SEQ ID NO: 16771 - protein, 26 aa, Brucella spp.
EKAGQLYGMGFIGGFCHLYIGQEAVV

SEQ ID NO: 16772 - protein, 17 aa, Brucella spp.
HGHMLAVGMSARGVMAE

SEQ ID NO: 16773 - protein, 20 aa, Brucella spp.
VSLGTGLAFANHYRENKSVS

SEQ ID NO: 16774 - protein, 32 aa, Brucella spp.
QVYESFNMASLWKLPVIYVIENNRYAMGTAVS

SEQ ID NO: 16775 - protein, 19 aa, Brucella spp.
GRGPIILEMLTYRYRGHSM

SEQ ID NO: 16776 - protein, 26 aa, Brucella spp.
FAGLKPIVEFMTFNFAMQAIDQIVNS

SEQ ID NO: 16777 - protein, 17 aa, Brucella spp.
MGAPMVFRGPSGAAARV

SEQ ID NO: 16778 - protein, 18 aa, Brucella spp.
HIPGLKVVMPYTAADAKG

SEQ ID NO: 16779 - protein, 32 aa, Brucella spp.
LENEILYGHHFDVPKLDDFVLPIGKARIHKQG

SEQ ID NO: 16780 - protein, 19 aa, Brucella spp.
TIVSFGIGMTYAVKAAEEL

SEQ ID NO: 16781 - protein, 19 aa, Brucella spp.
IDLRTIRPMDIATVVESVK

SEQ ID NO: 16782 - protein, 17 aa, Brucella spp.
GNLSKWLVKEGDKVAPG

SEQ ID NO: 16783 - protein, 22 aa, Brucella spp.
TEGVKVNALIAVLAEEGEDVAA

SEQ ID NO: 16784 - protein, 21 aa, Brucella spp.
GERVFASPLARRIAKDAGVDI

SEQ ID NO: 16785 - protein, 25 aa, Brucella spp.
LTIDCELDALLALRSQINAAAPMLK

SEQ ID NO: 16786 - protein, 19 aa, Brucella spp.
EVPAYKLSVNDMVIKATAL

SEQ ID NO: 16787 - protein, 26 aa, Brucella spp.
SNLGMFGVKDFAAIINPPHATIFAIG

SEQ ID NO: 16788 - protein, 18 aa, Brucella spp.
IINPPHATIFAIGAGEER

SEQ ID NO: 16789 - protein, 19 aa, Brucella spp.
PPHATIFAIGAGEERAVVK

SEQ ID NO: 16790 - protein, 35 aa, Brucella spp.
VEREHLGGICLNWGCIPTKALLRSAEILHFGEHAK

SEQ ID NO: 16791 - protein, 22 aa, Brucella spp.
VSARLNGGVAFLMKKNKIDVIW

SEQ ID NO: 16792 - protein, 27 aa, Brucella spp.
PGIEPDGKLIWTYFEAMVPQALPKSML

SEQ ID NO: 16793 - protein, 21 aa, Brucella spp.
FEAMVPQALPKSMLVMGSGAI

SEQ ID NO: 16794 - protein, 23 aa, Brucella spp.
AEVTELIQGFVIAMNLETTEEEL

SEQ ID NO: 16795 - protein, 18 aa, Brucella spp.
AFGLIWAPVFRALGLAAR

SEQ ID NO: 16796 - protein, 22 aa, Brucella spp.
DNEVLKKPDWIRVKAPVSRGYG

SEQ ID NO: 16797 - protein, 23 aa, Brucella spp.
ATTIEILTPDFLRKEGALEIVVK

SEQ ID NO: 16798 - protein, 17 aa, Brucella spp.
VPSKYLKVRPGARYFHS

SEQ ID NO: 16799 - protein, 19 aa, Brucella spp.
ARYFHSIRLLQRVKELDPT

SEQ ID NO: 16800 - protein, 17 aa, Brucella spp.
KPDEFKSFETIGKTKGF

SEQ ID NO: 16801 - protein, 17 aa, Brucella spp.
PKQYRLIGAEAVLARTL

SEQ ID NO: 16802 - protein, 27 aa, Brucella spp.
YRLIGAEAVLARTLRAFTDCPLIGTIA

SEQ ID NO: 16803 - protein, 23 aa, Brucella spp.
AFTDCPLIGTIAVVIHPDDHALY

SEQ ID NO: 16804 - protein, 19 aa, Brucella spp.
TGLFAAQTPQAFPYAPILD

SEQ ID NO: 16805 - protein, 20 aa, Brucella spp.
AQTPQAFPYAPILDAHEKAF

SEQ ID NO: 16806 - protein, 25 aa, Brucella spp.
SDPQWKGAASRIFIEHAAKIVREAG

SEQ ID NO: 16807 - protein, 17 aa, Brucella spp.
APMSGVSDLPFRKRAAE

SEQ ID NO: 16808 - protein, 17 aa, Brucella spp.
VSDLPFRKRAAEAGAGM

SEQ ID NO: 16809 - protein, 18 aa, Brucella spp.
KRAAEAGAGMVVSEMVAS

SEQ ID NO: 16810 - protein, 25 aa, Brucella spp.
AVKVPVTLKMRLGWDENSINAPELA

SEQ ID NO: 16811 - protein, 19 aa, Brucella spp.
VVETLRRIFLRDVDPLRKV

SEQ ID NO: 16812 - protein, 23 aa, Brucella spp.
RVTSNAASLWRWVAAGDGDLVIS

SEQ ID NO: 16813 - protein, 24 aa, Brucella spp.
MMPDENAFDLLPRIKKIRPDLPVV

SEQ ID NO: 16814 - protein, 21 aa, Brucella spp.
KPFDLTELINIVGRALSEPRQ

SEQ ID NO: 16815 - protein, 17 aa, Brucella spp.
KGPFVAINMAAIPRDLI

SEQ ID NO: 16816 - protein, 18 aa, Brucella spp.
DVPDLVRHFFKRAAEEGV

SEQ ID NO: 16817 - protein, 17 aa, Brucella spp.
DLVRHFFKRAAEEGVPE

SEQ ID NO: 16818 - protein, 24 aa, Brucella spp.
RVLAEVEYPLILACLTATRGNQIK

SEQ ID NO: 16819 - protein, 23 aa, Brucella spp.
GEGRRLLALPGIITVVSALVTAS

SEQ ID NO: 16820 - protein, 26 aa, Brucella spp.
LVTASFSFAILIGITPITPDRTVTLA

SEQ ID NO: 16821 - protein, 23 aa, Brucella spp.
ITPDRTVTLALVIINVALILFLI

SEQ ID NO: 16822 - protein, 24 aa, Brucella spp.
VIINVALILFLILLICREVYRIIT

SEQ ID NO: 16823 - protein, 24 aa, Brucella spp.
LLICREVYRIITARRLGKAASRLH

SEQ ID NO: 16824 - protein, 23 aa, Brucella spp.
SRLHVRIVALFSLIAAIPAIVVA

SEQ ID NO: 16825 - protein, 18 aa, Brucella spp.
LGLDRWFDQNTRDIISSS

SEQ ID NO: 16826 - protein, 20 aa, Brucella spp.
LDRNGFIQLMTLQVRGRALL

SEQ ID NO: 16827 - protein, 24 aa, Brucella spp.
LQVRGRALLGAFLVRDNGDVVVQS

SEQ ID NO: 16828 - protein, 21 aa, Brucella spp.
MREIPDMYLYTVRSVPPQILD

SEQ ID NO: 16829 - protein, 37 aa, Brucella spp.
DANRIPTQIAFALLYFGLTLIVLLSAIWTGIAVADRL

SEQ ID NO: 16830 - protein, 21 aa, Brucella spp.
VADRLVRPIRLLIGASDDVAA

SEQ ID NO: 16831 - protein, 23 aa, Brucella spp.
SIAPEVGQAFEVARATGRTVHRE

SEQ ID NO: 16832 - protein, 21 aa, Brucella spp.
REKGTGLGLAIVRKIVEDHGG

SEQ ID NO: 16833 - protein, 23 aa, Brucella spp.
HAGRGAMIRMVFPEDPPIPSDAD

SEQ ID NO: 16834 - protein, 25 aa, Brucella spp.
NDRAPRLVFLDIWLQGSRLDGLALL

SEQ ID NO: 16835 - protein, 21 aa, Brucella spp.
GSRLDGLALLDEIKKQHPELP

SEQ ID NO: 16836 - protein, 21 aa, Brucella spp.
QHPELPVVMISGHGNIETAVS

SEQ ID NO: 16837 - protein, 17 aa, Brucella spp.
KPFKADRLILVAERALE

SEQ ID NO: 16838 - protein, 18 aa, Brucella spp.
AHGGILYLDEVADMPRET

SEQ ID NO: 16839 - protein, 19 aa, Brucella spp.
MIAEGTFREDLFHRLSVVP

SEQ ID NO: 16840 - protein, 25 aa, Brucella spp.
ARREDIPSLVEFFMKQIAEQAGIKP

SEQ ID NO: 16841 - protein, 18 aa, Brucella spp.
PDAMAVLQAHSWPGNLRQ

SEQ ID NO: 16842 - protein, 17 aa, Brucella spp.
MAVLQAHSWPGNLRQLR

SEQ ID NO: 16843 - protein, 18 aa, Brucella spp.
VLQAHSWPGNLRQLRNNV

SEQ ID NO: 16844 - protein, 19 aa, Brucella spp.
LVTADLLPAEIGDTLPRAP

SEQ ID NO: 16845 - protein, 21 aa, Brucella spp.
FEKEYLIAQINRFGGNISRTA

SEQ ID NO: 16846 - protein, 17 aa, Brucella spp.
IAQINRFGGNISRTAEF

SEQ ID NO: 16847 - protein, 21 aa, Brucella spp.
LKAEYQDLFLRENLPIDVIIS

SEQ ID NO: 16848 - protein, 18 aa, Brucella spp.
RENLPIDVIISPEIEVGE

SEQ ID NO: 16849 - protein, 17 aa, Brucella spp.
IEVGEVVLRRIALQGAT

SEQ ID NO: 16850 - protein, 18 aa, Brucella spp.
VINTPLRQLTELFPDLTA

SEQ ID NO: 16851 - protein, 17 aa, Brucella spp.
DLTATVVGVVRNDSLFI

SEQ ID NO: 16852 - protein, 19 aa, Brucella spp.
HERAFAIADQLKRTMVLHG

SEQ ID NO: 16853 - protein, 18 aa, Brucella spp.
RRGRISAVYSIYRDRAEL

SEQ ID NO: 16854 - protein, 27 aa, Brucella spp.
PLRDLDLPEGLRIGAIYRDGEMIRPNG

SEQ ID NO: 16855 - protein, 18 aa, Brucella spp.
QFSDIFRIMLIKYQQGVW

SEQ ID NO: 16856 - protein, 18 aa, Brucella spp.
AAPQENFYYWVGKEATRI

SEQ ID NO: 16857 - protein, 24 aa, Brucella spp.
VSFQPGSFYMWAIDRVRPLLESKE

SEQ ID NO: 16858 - protein, 21 aa, Brucella spp.
PKPTRAAVIVPVLPDRYNSGS

SEQ ID NO: 16859 - protein, 23 aa, Brucella spp.
ARLEEAIGLARAIGLDIEHAEIA

SEQ ID NO: 16860 - protein, 23 aa, Brucella spp.
VIDRTGLILEIFGERARTKEGAL

SEQ ID NO: 16861 - protein, 23 aa, Brucella spp.
RKVPHPIVALVGYTNAGKSMLFN

SEQ ID NO: 16862 - protein, 24 aa, Brucella spp.
FISNLPHHLVAAFRATLEEVVEAD

SEQ ID NO: 16863 - protein, 20 aa, Brucella spp.
LSLIETRIAGALGSVDLVLS

SEQ ID NO: 16864 - protein, 18 aa, Brucella spp.
TRIAGALGSVDLVLSPFD

SEQ ID NO: 16865 - protein, 24 aa, Brucella spp.
VLSPFDLHLLDWIYQHGSDVQREN

SEQ ID NO: 16866 - protein, 23 aa, Brucella spp.
IFSRLLKERIIFVNGPVEDGMSM

SEQ ID NO: 16867 - protein, 24 aa, Brucella spp.
EDGMSMLVCAQLLFLEAENPKKEI

SEQ ID NO: 16868 - protein, 18 aa, Brucella spp.
RRLNEIYVKHTGRDYDTI

SEQ ID NO: 16869 - protein, 20 aa, Brucella spp.
TAQEALEFGLIDKVVEARDV

SEQ ID NO: 16870 - protein, 21 aa, Brucella spp.
EVRKLIAGPTVFICDECVELC

SEQ ID NO: 16871 - protein, 20 aa, Brucella spp.
ARIIDVPFIMADATTLTEAG

SEQ ID NO: 16872 - protein, 23 aa, Brucella spp.
TNILFICGGAFAGLDRIISARGE

SEQ ID NO: 16873 - protein, 17 aa, Brucella spp.
EKTSIGFGATVKSVDER

SEQ ID NO: 16874 - protein, 38 aa, Brucella spp.
EVFKELEPEDLLKFGLIPEFVGRLPVIATLEDLDVDAL

SEQ ID NO: 16875 - protein, 19 aa, Brucella spp.
SIMEKILLDTMFELPTLEG

SEQ ID NO: 16876 - protein, 18 aa, Brucella spp.
GGADGLYAVLPLRDIVVF

SEQ ID NO: 16877 - protein, 34 aa, Brucella spp.
GLYAVLPLRDIVVFPHMIVPLFVGREKSIRALEE

SEQ ID NO: 16878 - protein, 31 aa, Brucella spp.
SAEATVVRNYLDWLLSIPWGKKSKVKQDLNF

SEQ ID NO: 16879 - protein, 20 aa, Brucella spp.
PLLDRMEIIRIAGYTEDEKL

SEQ ID NO: 16880 - protein, 24 aa, Brucella spp.
NLSDYLGVEKFRFGQIDGEDQVGV

SEQ ID NO: 16881 - protein, 23 aa, Brucella spp.
EDQVGVVTGLAWTEVGGELLTIE

SEQ ID NO: 16882 - protein, 20 aa, Brucella spp.
RSRAIDFGIEPPLFDKRDIH

SEQ ID NO: 16883 - protein, 17 aa, Brucella spp.
LDLPRDKLIVMTGLSGS

SEQ ID NO: 16884 - protein, 25 aa, Brucella spp.
TVTEIYDYMRLLFARVGIPYSPATG

SEQ ID NO: 16885 - protein, 17 aa, Brucella spp.
VGIPYSPATGLPIESQT

SEQ ID NO: 16886 - protein, 25 aa, Brucella spp.
IALEEGTRLYILAPIVRGRKGEYRK

SEQ ID NO: 16887 - protein, 18 aa, Brucella spp.
GTFYEIADVPPLDKKYKH

SEQ ID NO: 16888 - protein, 25 aa, Brucella spp.
SLETCLKLADGLAIAEFADKPLPVG

SEQ ID NO: 16889 - protein, 28 aa, Brucella spp.
FSEKFACPVSGFTIPEIEPRLFSFNNPF

SEQ ID NO: 16890 - protein, 26 aa, Brucella spp.
IPEIEPRLFSFNNPFGACPTCDGLGT

SEQ ID NO: 16891 - protein, 23 aa, Brucella spp.
GKAYGFKVSARWSELSEEARQAI

SEQ ID NO: 16892 - protein, 17 aa, Brucella spp.
CNGYRLKPEALSVKIGK

SEQ ID NO: 16893 - protein, 18 aa, Brucella spp.
RILKEIRERLQFLNDVGL

SEQ ID NO: 16894 - protein, 18 aa, Brucella spp.
RERLQFLNDVGLDYLTLA

SEQ ID NO: 16895 - protein, 19 aa, Brucella spp.
VSADIPLGTFTAVTGVSGG

SEQ ID NO: 16896 - protein, 19 aa, Brucella spp.
HDRIEGLEFLDKVIDIDQS

SEQ ID NO: 16897 - protein, 22 aa, Brucella spp.
YTGAFTPIRDWFAGLPEAKARG

SEQ ID NO: 16898 - protein, 23 aa, Brucella spp.
DGVIKIEMHFLPDVYVTCDVCHG

SEQ ID NO: 16899 - protein, 20 aa, Brucella spp.
TVEEGAEFFSAVPAVRDKLE

SEQ ID NO: 16900 - protein, 23 aa, Brucella spp.
RDKLETLVKVGLGYIKVGQQATT

SEQ ID NO: 16901 - protein, 18 aa, Brucella spp.
VIKTADWVIDLGPEGGDG

SEQ ID NO: 16902 - protein, 17 aa, Brucella spp.
VANLRIATSESWRDRQT

SEQ ID NO: 16903 - protein, 21 aa, Brucella spp.
TEWHSVVIFNENLAKVAEQYL

SEQ ID NO: 16904 - protein, 18 aa, Brucella spp.
VYIEGALQTRKWQDQNGN

SEQ ID NO: 16905 - protein, 24 aa, Brucella spp.
GAFRVAGGLLLFWIAFEMIFEKRT

SEQ ID NO: 16906 - protein, 17 aa, Brucella spp.
IAAFPLAIPLIAGPGAI

SEQ ID NO: 16907 - protein, 23 aa, Brucella spp.
VIFVCLLITYFVLLLAERVDRFL

SEQ ID NO: 16908 - protein, 22 aa, Brucella spp.
YLDYAMSVIVSRALPDVRDGLK

SEQ ID NO: 16909 - protein, 17 aa, Brucella spp.
HGDASIYDALVRMAQDF

SEQ ID NO: 16910 - protein, 25 aa, Brucella spp.
REQEPVVLPARFPNLLVNGSGGIAV

SEQ ID NO: 16911 - protein, 36 aa, Brucella spp.
NPAIELSELMELIPGPDFPTGGIILGRNGINSAYTT

SEQ ID NO: 16912 - protein, 18 aa, Brucella spp.
DREAIIITEIPYQVNKAS

SEQ ID NO: 16913 - protein, 18 aa, Brucella spp.
DAVADVVLNQLYRYTPLQ

SEQ ID NO: 16914 - protein, 26 aa, Brucella spp.
KPEQLTLLDMLRAFVAFREEVVTRRT

SEQ ID NO: 16915 - protein, 18 aa, Brucella spp.
DRAHVLVGLAIAVANIDE

SEQ ID NO: 16916 - protein, 27 aa, Brucella spp.
MERRWPAVDVAPLIRLIDDPRHTLNED

SEQ ID NO: 16917 - protein, 20 aa, Brucella spp.
NTHTPVLFFSSRGIVYKEKL

SEQ ID NO: 16918 - protein, 22 aa, Brucella spp.
RGIVYKEKLWRLPVGTPQSRGK

SEQ ID NO: 16919 - protein, 17 aa, Brucella spp.
QQGERITTIMPLPEDED

SEQ ID NO: 16920 - protein, 26 aa, Brucella spp.
GQCIRFPVTDVRVFAGRNSIGVRGIN

SEQ ID NO: 16921 - protein, 17 aa, Brucella spp.
KVISMAILHHVDATPAE

SEQ ID NO: 16922 - protein, 17 aa, Brucella spp.
REETVLTVSEFGYGKRS

SEQ ID NO: 16923 - protein, 24 aa, Brucella spp.
KTDEIGKLVALFPVEGSDQILLVS

SEQ ID NO: 16924 - protein, 21 aa, Brucella spp.
LFPVEGSDQILLVSDGGQLIR

SEQ ID NO: 16925 - protein, 18 aa, Brucella spp.
KKPLFSFDERVALIEASA

SEQ ID NO: 16926 - protein, 23 aa, Brucella spp.
TMAPELQTVFLPADPAVRTITAT

SEQ ID NO: 16927 - protein, 17 aa, Brucella spp.
IKPFVPVAVAAALNTKF

SEQ ID NO: 16928 - protein, 18 aa, Brucella spp.
PDRWKAFLRPAKRVKEGD

SEQ ID NO: 16929 - protein, 19 aa, Brucella spp.
RIRFGHSGTSCFLGTLDAT

SEQ ID NO: 16930 - protein, 22 aa, Brucella spp.
GDSGEALLVFDLSGAVLDEAIA

SEQ ID NO: 16931 - protein, 19 aa, Brucella spp.
GHIPLPPYIASKRPEDERD

SEQ ID NO: 16932 - protein, 20 aa, Brucella spp.
SGATDIFITPGYRFRAVDLL

SEQ ID NO: 16933 - protein, 22 aa, Brucella spp.
FITPGYRFRAVDLLMTNFHLPR

SEQ ID NO: 16934 - protein, 18 aa, Brucella spp.
FRAVDLLMTNFHLPRSTL

SEQ ID NO: 16935 - protein, 25 aa, Brucella spp.
TNFHLPRSTLFMLVSAFSGLDTMHA

SEQ ID NO: 16936 - protein, 25 aa, Brucella spp.
IFLVVVVGGLIGFNLFRSKMIKDFF

SEQ ID NO: 16937 - protein, 18 aa, Brucella spp.
RSKMIKDFFANMQQPAQT

SEQ ID NO: 16938 - protein, 17 aa, Brucella spp.
VEPGVWQPGVEAIGTAS

SEQ ID NO: 16939 - protein, 23 aa, Brucella spp.
IMRIDFTVPEQLLATIKLGQTVK

SEQ ID NO: 16940 - protein, 24 aa, Brucella spp.
VELPEESNVIALPQTSIVSSLYGD

SEQ ID NO: 16941 - protein, 17 aa, Brucella spp.
KYLPGLVSGELIGCFGL

SEQ ID NO: 16942 - protein, 24 aa, Brucella spp.
PGLVSGELIGCFGLTEPDAGSDPA

SEQ ID NO: 16943 - protein, 23 aa, Brucella spp.
FGCFNRARYGISWGVIGAAEDCW

SEQ ID NO: 16944 - protein, 18 aa, Brucella spp.
AEDCWFRARQYGLDRKQF

SEQ ID NO: 16945 - protein, 26 aa, Brucella spp.
EGAAFMPRFDASGLITAIVTDARDGE

SEQ ID NO: 16946 - protein, 25 aa, Brucella spp.
LRLTLETGIAHYWSRSRKTLWKKGE

SEQ ID NO: 16947 - protein, 17 aa, Brucella spp.
QDALWLKVHVAGDGPTC

SEQ ID NO: 16948 - protein, 24 aa, Brucella spp.
AEAEAAVRTLLLWAGEDPDREGLL

SEQ ID NO: 16949 - protein, 23 aa, Brucella spp.
AYLPEGRVVGLSKIARVVDIFAR

SEQ ID NO: 16950 - protein, 17 aa, Brucella spp.
SKIARVVDIFARRLQTQ

SEQ ID NO: 16951 - protein, 19 aa, Brucella spp.
AIARHGLWRGGWMGFFRVV

SEQ ID NO: 16952 - protein, 24 aa, Brucella spp.
ELSPDLKWYMPWRYWRCSASRIGK

SEQ ID NO: 16953 - protein, 26 aa, Brucella spp.
GPVIENGFYYDFARNEPFTLDDLPVI

SEQ ID NO: 16954 - protein, 18 aa, Brucella spp.
RNEPFTLDDLPVIEKKMR

SEQ ID NO: 16955 - protein, 17 aa, Brucella spp.
ESYKVELVDAIPAGQDL

SEQ ID NO: 16956 - protein, 17 aa, Brucella spp.
LVDAIPAGQDLKIYYQG

SEQ ID NO: 16957 - protein, 20 aa, Brucella spp.
EGPGVVFWHAKGWKMFQNLV

SEQ ID NO: 16958 - protein, 23 aa, Brucella spp.
WHAKGWKMFQNLVSYMRRRLDSH

SEQ ID NO: 16959 - protein, 27 aa, Brucella spp.
DKSLWETSGHWGWYRDNMFKVTVAGDD

SEQ ID NO: 16960 - protein, 17 aa, Brucella spp.
WYRDNMFKVTVAGDDTD

SEQ ID NO: 16961 - protein, 17 aa, Brucella spp.
NCPGHVQIFKHGLKSYR

SEQ ID NO: 16962 - protein, 17 aa, Brucella spp.
EPSGALHGLMRVRGFTQ

SEQ ID NO: 16963 - protein, 17 aa, Brucella spp.
SGALHGLMRVRGFTQDD

SEQ ID NO: 16964 - protein, 20 aa, Brucella spp.
LQINDLILSVYKDFGFEEIT

SEQ ID NO: 16965 - protein, 20 aa, Brucella spp.
FEYTLKDAIGREWQCGTTQV

SEQ ID NO: 16966 - protein, 24 aa, Brucella spp.
VDFNLPERFGAFYIGADSEKKQPV

SEQ ID NO: 16967 - protein, 24 aa, Brucella spp.
ICGSMERFLGILIENFAGHMPLWF

SEQ ID NO: 16968 - protein, 23 aa, Brucella spp.
ENFAGHMPLWFAPVQVVVATITS

SEQ ID NO: 16969 - protein, 22 aa, Brucella spp.
GKRLRDGVVWRAVAATLVASPA

SEQ ID NO: 16970 - protein, 28 aa, Brucella spp.
TQEGGDIPAGLVWRVFSPDVGPDGQLPL

SEQ ID NO: 16971 - protein, 22 aa, Brucella spp.
LPEGSYLVHVAYGRAGATKRIT

SEQ ID NO: 16972 - protein, 17 aa, Brucella spp.
HEIMILDAGGMKLSAVL

SEQ ID NO: 16973 - protein, 21 aa, Brucella spp.
GKIKDDLLRFSIYADEENSDR

SEQ ID NO: 16974 - protein, 21 aa, Brucella spp.
PETGCPWDIEQNFRTIAPYTL

SEQ ID NO: 16975 - protein, 23 aa, Brucella spp.
REELGDLLLQVVFHARMAEEQGY

SEQ ID NO: 16976 - protein, 25 aa, Brucella spp.
FVDDIPNAFPALLRALKLQQKAAKV

SEQ ID NO: 16977 - protein, 17 aa, Brucella spp.
QQKAAKVGFDWSEAAPI

SEQ ID NO: 16978 - protein, 20 aa, Brucella spp.
AAKVGFDWSEAAPILDKIAE

SEQ ID NO: 16979 - protein, 17 aa, Brucella spp.
YGDLLFAMVNLGRHLEI

SEQ ID NO: 16980 - protein, 26 aa, Brucella spp.
VLPVRGEFAVWFALATKIAVGLLFFL

SEQ ID NO: 16981 - protein, 17 aa, Brucella spp.
LATKIAVGLLFFLHGAR

SEQ ID NO: 16982 - protein, 21 aa, Brucella spp.
TKIAVGLLFFLHGARLSREAV

SEQ ID NO: 16983 - protein, 20 aa, Brucella spp.
LESILLQLLAPFVLGQVLQP

SEQ ID NO: 16984 - protein, 19 aa, Brucella spp.
AIVEGLWRTVSWDDLGMMV

SEQ ID NO: 16985 - protein, 17 aa, Brucella spp.
DGMIVGMSGFTRAGDAK

SEQ ID NO: 16986 - protein, 22 aa, Brucella spp.
MACDSRIGLPYIPIAPEKIAGI

SEQ ID NO: 16987 - protein, 19 aa, Brucella spp.
GHLIEFFKGEVVKGRLDLA

SEQ ID NO: 16988 - protein, 21 aa, Brucella spp.
KGEVVKGRLDLALNPLQAGIG

SEQ ID NO: 16989 - protein, 28 aa, Brucella spp.
ISNHPEVIRRLGIIGINTALEFDIYGNV

SEQ ID NO: 16990 - protein, 18 aa, Brucella spp.
INTALEFDIYGNVNSTHV

SEQ ID NO: 16991 - protein, 18 aa, Brucella spp.
SGDFARNAYISIFVSKSE

SEQ ID NO: 16992 - protein, 20 aa, Brucella spp.
TVEILYFGLIADFQGRGLAR

SEQ ID NO: 16993 - protein, 23 aa, Brucella spp.
EYEKAHIPGAVFFDQDKIADKES

SEQ ID NO: 16994 - protein, 19 aa, Brucella spp.
SGLPHTLPSPEFFAQQVGT

SEQ ID NO: 16995 - protein, 27 aa, Brucella spp.
GPGMFSAPRVWWMFRVMGVKNVYVLDG

SEQ ID NO: 16996 - protein, 25 aa, Brucella spp.
PDVGEKLVLHIDWQRRYKLMRMHTA

SEQ ID NO: 16997 - protein, 25 aa, Brucella spp.
ACHLLSVACPFPITGAAVGEDESRV

SEQ ID NO: 16998 - protein, 23 aa, Brucella spp.
LVQANAPVSIHWISDEEFLANPD

SEQ ID NO: 16999 - protein, 19 aa, Brucella spp.
PPVGLGRIRLVAIGENGSV

SEQ ID NO: 17000 - protein, 19 aa, Brucella spp.
LADPHGAALHAFYTTGELK

SEQ ID NO: 17001 - protein, 17 aa, Brucella spp.
AALHAFYTTGELKAEGD

SEQ ID NO: 17002 - protein, 25 aa, Brucella spp.
YQIPDAEALDILFALVEEEGLCLGG

SEQ ID NO: 17003 - protein, 20 aa, Brucella spp.
LRGKSLPVPRWLEKKTEIDI

SEQ ID NO: 17004 - protein, 23 aa, Brucella spp.
VRSYKLRGAFNFISKAVETTDKN

SEQ ID NO: 17005 - protein, 18 aa, Brucella spp.
AQGFAFVCRHFGRKGVVF

SEQ ID NO: 17006 - protein, 26 aa, Brucella spp.
QYIADLGWKTAFRFVEPQGAASLKAS

SEQ ID NO: 17007 - protein, 19 aa, Brucella spp.
PAGALGIDALKDFKKSDIK

SEQ ID NO: 17008 - protein, 24 aa, Brucella spp.
LRFEGLKKYFIFRFPQCPGALRSF

SEQ ID NO: 17009 - protein, 23 aa, Brucella spp.
RFPQCPGALRSFLDLLGPDDDIA

SEQ ID NO: 17010 - protein, 17 aa, Brucella spp.
GAELALISTQWQMQHHG

SEQ ID NO: 17011 - protein, 20 aa, Brucella spp.
HGMIIVPLSYAYREQMGNDV

SEQ ID NO: 17012 - protein, 24 aa, Brucella spp.
EIKNPDGSIVFRLENINVPAQFSQ

SEQ ID NO: 17013 - protein, 17 aa, Brucella spp.
ENINVPAQFSQVAADIL

SEQ ID NO: 17014 - protein, 23 aa, Brucella spp.
VEENDVPSWLWRSVADEDALSKL

SEQ ID NO: 17015 - protein, 30 aa, Brucella spp.
DACQVFDRLAGTWTYWGWKGGYFDSEEDAV

SEQ ID NO: 17016 - protein, 27 aa, Brucella spp.
PNSPQWFNTGLSWAYGIDGPGQGHFYV

SEQ ID NO: 17017 - protein, 27 aa, Brucella spp.
VNEGGIMDLWVREARLFKYGSGTGSNF

SEQ ID NO: 17018 - protein, 19 aa, Brucella spp.
SGLMSFLKIGDRAAGAIKS

SEQ ID NO: 17019 - protein, 20 aa, Brucella spp.
PENYVKRVIQFARQGYTDIQ

SEQ ID NO: 17020 - protein, 18 aa, Brucella spp.
SVSLKDEFLRAVENDGDW

SEQ ID NO: 17021 - protein, 19 aa, Brucella spp.
AVENDGDWNLTARRDGRVM

SEQ ID NO: 17022 - protein, 20 aa, Brucella spp.
ACNLASINLLTYRNKDGSFD

SEQ ID NO: 17023 - protein, 25 aa, Brucella spp.
AYEHTARLWTIVLEISVMMAQFPSR

SEQ ID NO: 17024 - protein, 30 aa, Brucella spp.
PDFALVKFKKLAGGGYFKIINRAVPEALRT

SEQ ID NO: 17025 - protein, 26 aa, Brucella spp.
AALKSAFDIKFAFNKWTLGEDFCKDV

SEQ ID NO: 17026 - protein, 26 aa, Brucella spp.
QLNDFSFELLPVLGFSKKDIEAANIH

SEQ ID NO: 17027 - protein, 27 aa, Brucella spp.
EDCKNAYMLSWKLALKANALYRDGSKL

SEQ ID NO: 17028 - protein, 17 aa, Brucella spp.
MHKEGAAFRAMMNNFAI

SEQ ID NO: 17029 - protein, 20 aa, Brucella spp.
EGAAFRAMMNNFAIAVSLGL

SEQ ID NO: 17030 - protein, 26 aa, Brucella spp.
RAMMNNFAIAVSLGLQYGVPLEEYVE

SEQ ID NO: 17031 - protein, 27 aa, Brucella spp.
GVPLEEYVEAFTFTKFEPAGMVIGNDA

SEQ ID NO: 17032 - protein, 24 aa, Brucella spp.
ILALLVLGLVIWLAVKPPELLRLG

SEQ ID NO: 17033 - protein, 17 aa, Brucella spp.
PPELLRLGTAYAAKIVC

SEQ ID NO: 17034 - protein, 20 aa, Brucella spp.
AKIVCSNVFIAGRDADAVLA

SEQ ID NO: 17035 - protein, 21 aa, Brucella spp.
RMALARYNLFPQWKTDGRSQI

SEQ ID NO: 17036 - protein, 23 aa, Brucella spp.
EALDFPMHALFDPLGLSNAVLEM

SEQ ID NO: 17037 - protein, 17 aa, Brucella spp.
TARDWARIDAFLADGGV

SEQ ID NO: 17038 - protein, 21 aa, Brucella spp.
KRLLPEGFVSFMAKPSQASLG

SEQ ID NO: 17039 - protein, 23 aa, Brucella spp.
GTEGIPKDAFWMFGHDGQSVMIV

SEQ ID NO: 17040 - protein, 18 aa, Brucella spp.
AKLVAWKNDILREARETL

SEQ ID NO: 17041 - protein, 23 aa, Brucella spp.
FCEETGDPISLKRLDARPIATLS

SEQ ID NO: 17042 - protein, 22 aa, Brucella spp.
IEYETASAWGRWLSPGRLSVDI

SEQ ID NO: 17043 - protein, 27 aa, Brucella spp.
DIVDYPGEWLLDLPLLGKTYAQFSADS

SEQ ID NO: 17044 - protein, 21 aa, Brucella spp.
YEAYKTYVVKPFFREHIARLD

SEQ ID NO: 17045 - protein, 17 aa, Brucella spp.
YVVKPFFREHIARLDRQ

SEQ ID NO: 17046 - protein, 18 aa, Brucella spp.
RALTDILSCFRPGRSNLL

SEQ ID NO: 17047 - protein, 18 aa, Brucella spp.
NETLPVIVGTPLKGERID

SEQ ID NO: 17048 - protein, 21 aa, Brucella spp.
ERKGWSLSRILFGALGILVSF

SEQ ID NO: 17049 - protein, 25 aa, Brucella spp.
ILFGALGILVSFAIGIWTEDLIRAL

SEQ ID NO: 17050 - protein, 27 aa, Brucella spp.
DLIRALFARADWLGWTALGVAMVALAA

SEQ ID NO: 17051 - protein, 19 aa, Brucella spp.
AIILRELVALRRLASVQHL

SEQ ID NO: 17052 - protein, 17 aa, Brucella spp.
TLGFIKFARRVIAHLAV

SEQ ID NO: 17053 - protein, 22 aa, Brucella spp.
IGIAAMDVVRPFPFNAEKRPGI

SEQ ID NO: 17054 - protein, 17 aa, Brucella spp.
VVRPFPFNAEKRPGIGD

SEQ ID NO: 17055 - protein, 20 aa, Brucella spp.
EKELVPVIGMSLKRVDTIAV

SEQ ID NO: 17056 - protein, 17 aa, Brucella spp.
LIAVCLDVERSLKRVRL

SEQ ID NO: 17057 - protein, 17 aa, Brucella spp.
WGPRIIDIDILVMQDET

SEQ ID NO: 17058 - protein, 38 aa, Brucella spp.
LEVEKALEQALDIDFGDDIYIDMDLGAFDEGFSIDDLE

SEQ ID NO: 17059 - protein, 19 aa, Brucella spp.
GAFDEGFSIDDLEEQISRA

SEQ ID NO: 17060 - protein, 33 aa, Brucella spp.
RRITEHSSKLYWTTTAISVAWAAGGVAISKAIN

SEQ ID NO: 17061 - protein, 19 aa, Brucella spp.
EVFSSLQATKDFFTAPAGL

SEQ ID NO: 17062 - protein, 19 aa, Brucella spp.
LQATKDFFTAPAGLGVVAG

SEQ ID NO: 17063 - protein, 34 aa, Brucella spp.
APAGLGVVAGVALPIAMFWGFAQLVKRAQEMQNA

SEQ ID NO: 17064 - protein, 20 aa, Brucella spp.
KLLQPEAVAGDRVSTLGQAV

SEQ ID NO: 17065 - protein, 26 aa, Brucella spp.
MNEGIERTLARAVELETLVQSEVNQL

SEQ ID NO: 17066 - protein, 19 aa, Brucella spp.
LREELSSASNIIRDNVLSA

SEQ ID NO: 17067 - protein, 23 aa, Brucella spp.
LSDRGRSLLAEFEARAHALDNST

SEQ ID NO: 17068 - protein, 20 aa, Brucella spp.
RTREIAETFSGGRNSLGAMV

SEQ ID NO: 17069 - protein, 18 aa, Brucella spp.
VDDIKVKIGDDLTSISES

SEQ ID NO: 17070 - protein, 20 aa, Brucella spp.
ESVGNVLIDKAAAFEGKLAE

SEQ ID NO: 17071 - protein, 18 aa, Brucella spp.
MDERAAAMRENFNENREV

SEQ ID NO: 17072 - protein, 20 aa, Brucella spp.
MEKALSIGVDNVRRALEQSA

SEQ ID NO: 17073 - protein, 24 aa, Brucella spp.
LDGFGESFSARLIDNLSGTEARLG

SEQ ID NO: 17074 - protein, 21 aa, Brucella spp.
RADAIATRLGDIGSRITMELG

SEQ ID NO: 17075 - protein, 18 aa, Brucella spp.
LGDIGSRITMELGSVEAR

SEQ ID NO: 17076 - protein, 20 aa, Brucella spp.
GSRITMELGSVEARIAQVTD

SEQ ID NO: 17077 - protein, 22 aa, Brucella spp.
ERTRELNAVLAARSQEITKILN

SEQ ID NO: 17078 - protein, 18 aa, Brucella spp.
IDGRLVDSTTSFVENTNR

SEQ ID NO: 17079 - protein, 17 aa, Brucella spp.
VDSTTSFVENTNRAAQM

SEQ ID NO: 17080 - protein, 25 aa, Brucella spp.
LMQSFEALVASAFQRAEGQTRVSAE

SEQ ID NO: 17081 - protein, 17 aa, Brucella spp.
PAASAEKPRGWVSDLLA

SEQ ID NO: 17082 - protein, 22 aa, Brucella spp.
ASAEKPRGWVSDLLARASREEE

SEQ ID NO: 17083 - protein, 26 aa, Brucella spp.
ESLNSLSVDIARAIDHEASVELWDRY

SEQ ID NO: 17084 - protein, 22 aa, Brucella spp.
AIDHEASVELWDRYRRGERNVF

SEQ ID NO: 17085 - protein, 22 aa, Brucella spp.
FTRRLYTLKGQQTFDDIKRKYQ

SEQ ID NO: 17086 - protein, 17 aa, Brucella spp.
LKGQQTFDDIKRKYQTD

SEQ ID NO: 17087 - protein, 17 aa, Brucella spp.
YQTDGEFRRAVDRYMND

SEQ ID NO: 17088 - protein, 32 aa, Brucella spp.
LVGVFTLLVSLLAFGFVYWIARYGEARDSLPL

SEQ ID NO: 17089 - protein, 23 aa, Brucella spp.
EARDSLPLDVRIQGSVTGLGIGS

SEQ ID NO: 17090 - protein, 21 aa, Brucella spp.
DRFSGQGLREMQGVVIDSRRA

SEQ ID NO: 17091 - protein, 17 aa, Brucella spp.
RNPQRLIFGGPVSVPQY

SEQ ID NO: 17092 - protein, 19 aa, Brucella spp.
DFDEAALFFHRYPKPGKLE

SEQ ID NO: 17093 - protein, 19 aa, Brucella spp.
AVLFKKFADIDVFDIEIDA

SEQ ID NO: 17094 - protein, 17 aa, Brucella spp.
FADIDVFDIEIDAHEIN

SEQ ID NO: 17095 - protein, 24 aa, Brucella spp.
AALACLNLLVNLGAKRENIWVCDI

SEQ ID NO: 17096 - protein, 23 aa, Brucella spp.
KQMAEKPLIMALANPKPEIMPEE

SEQ ID NO: 17097 - protein, 29 aa, Brucella spp.
FPNQVNNVLCFPYIFRGALDVGATVINEE

SEQ ID NO: 17098 - protein, 18 aa, Brucella spp.
NEEMKLAAVRAIASLARE

SEQ ID NO: 17099 - protein, 19 aa, Brucella spp.
MKLAAVRAIASLAREEPSD

SEQ ID NO: 17100 - protein, 22 aa, Brucella spp.
FGPDYIIPSPFDQRLILRIAPA

SEQ ID NO: 17101 - protein, 31 aa, Brucella spp.
YLDRLNRFVFRSGLIMKPVFAAARTQGAPMR

SEQ ID NO: 17102 - protein, 20 aa, Brucella spp.
EERIAAPILVGRPQVVETRL

SEQ ID NO: 17103 - protein, 21 aa, Brucella spp.
EIAEMAVLAAREISRFGIEPK

SEQ ID NO: 17104 - protein, 24 aa, Brucella spp.
SRLKGEANLLVFPNLDAANITLNV

SEQ ID NO: 17105 - protein, 22 aa, Brucella spp.
RMQADLILFTELFISGYPPEDM

SEQ ID NO: 17106 - protein, 21 aa, Brucella spp.
PEDMVLKPAFVAACEKAVRML

SEQ ID NO: 17107 - protein, 18 aa, Brucella spp.
AFVAACEKAVRMLAADTA

SEQ ID NO: 17108 - protein, 21 aa, Brucella spp.
FEPGPMPGPVNFRGVRLGIPV

SEQ ID NO: 17109 - protein, 23 aa, Brucella spp.
KQVIETGLPIVYANQVGGQDELV

SEQ ID NO: 17110 - protein, 24 aa, Brucella spp.
CLQMPQFAEQIALTEWQRDGDGWR

SEQ ID NO: 17111 - protein, 20 aa, Brucella spp.
AADYAACMLGLRDYVNKNGF

SEQ ID NO: 17112 - protein, 25 aa, Brucella spp.
KDRVRCVMLPYRYTSEESLADAADC

SEQ ID NO: 17113 - protein, 18 aa, Brucella spp.
RGTILMAISNKFGSMVVT

SEQ ID NO: 17114 - protein, 17 aa, Brucella spp.
MSVGYATLYGDMNGGFN

SEQ ID NO: 17115 - protein, 23 aa, Brucella spp.
DVYKMQVYALSQWRNQNLPQGAL

SEQ ID NO: 17116 - protein, 18 aa, Brucella spp.
CGSLAVLIAILFVAVIWA

SEQ ID NO: 17117 - protein, 24 aa, Brucella spp.
RLIAPFSALVLMAGVHSAFTQEIS

SEQ ID NO: 17118 - protein, 23 aa, Brucella spp.
FTEDELKAITAFYTSPAGKKLLS

SEQ ID NO: 17119 - protein, 24 aa, Brucella spp.
IVTREVVKAANIWQNGVARDLARS

SEQ ID NO: 17120 - protein, 29 aa, Brucella spp.
VETLGRFPLPIEVNRFGLGATIRAIEAAA

SEQ ID NO: 17121 - protein, 30 aa, Brucella spp.
LFAIPGVVEHGLFIELARAAIIAGTDGIRT

SEQ ID NO: 17122 - protein, 21 aa, Brucella spp.
YEELSVKLLTSMGEAARFAAI

SEQ ID NO: 17123 - protein, 20 aa, Brucella spp.
TSMGEAARFAAICGADTFSW

SEQ ID NO: 17124 - protein, 24 aa, Brucella spp.
ARFAAICGADTFSWRKPDPRHLIE

SEQ ID NO: 17125 - protein, 24 aa, Brucella spp.
MEGGIKDGFALMLAAGRAVADIAQ

SEQ ID NO: 17126 - protein, 22 aa, Brucella spp.
AGYEAVCFAAAPPRQGTDAMRA

SEQ ID NO: 17127 - protein, 19 aa, Brucella spp.
FSPVSFGGIIDALYGAGLA

SEQ ID NO: 17128 - protein, 23 aa, Brucella spp.
DIGIPDRILGEINPRVFENSPEL

SEQ ID NO: 17129 - protein, 21 aa, Brucella spp.
HEGEFKRLFPDIAEDNTSKID

SEQ ID NO: 17130 - protein, 22 aa, Brucella spp.
PFAAACASVWVHADAARRFGHG

SEQ ID NO: 17131 - protein, 17 aa, Brucella spp.
VMFDGSSIAGWKAINES

SEQ ID NO: 17132 - protein, 22 aa, Brucella spp.
PDPETAHIDPFFAQSTLVILCD

SEQ ID NO: 17133 - protein, 18 aa, Brucella spp.
PEAEFFVFDDVKFKADPF

SEQ ID NO: 17134 - protein, 25 aa, Brucella spp.
RLVPGYEAPVLLAYSARNRSASCRI

SEQ ID NO: 17135 - protein, 29 aa, Brucella spp.
FPDPSANPYLCFSALLMAGLDGIKNKIHP

SEQ ID NO: 17136 - protein, 24 aa, Brucella spp.
SFIELKMAEVMRFEMTPHPVEFDM

SEQ ID NO: 17137 - protein, 22 aa, Brucella spp.
CVFLWCCWRRIPLFKRDDTLKP

SEQ ID NO: 17138 - protein, 21 aa, Brucella spp.
LFGTEFVLIFVAMDLTSVGRV

SEQ ID NO: 17139 - protein, 19 aa, Brucella spp.
EPLSWKIFAALALIGCGLL

SEQ ID NO: 17140 - protein, 18 aa, Brucella spp.
EAGMRLDRWFKIHYPGLG

SEQ ID NO: 17141 - protein, 32 aa, Brucella spp.
MRLDRWFKIHYPGLGFGHLQKLLRAGQVRVDG

SEQ ID NO: 17142 - protein, 26 aa, Brucella spp.
SQMLLYEDPKIFVFNKPAGLAVQGGS

SEQ ID NO: 17143 - protein, 25 aa, Brucella spp.
PKYFEADQNWEFPGGIQKRLHLHAR

SEQ ID NO: 17144 - protein, 21 aa, Brucella spp.
TLAEPVLFGRVIQSISDKGDI

SEQ ID NO: 17145 - protein, 27 aa, Brucella spp.
KGDIFSPLLMWAALGGFNIMAAVFVAR

SEQ ID NO: 17146 - protein, 25 aa, Brucella spp.
IDSYERLITMPLAWHQKRGTSNALH

SEQ ID NO: 17147 - protein, 20 aa, Brucella spp.
TDSLFTLWLEFMRQHLTTVV

SEQ ID NO: 17148 - protein, 27 aa, Brucella spp.
VAMTMDMRMSLVLIVLGVIYVMIGQLV

SEQ ID NO: 17149 - protein, 27 aa, Brucella spp.
NLENAQFPVLNWWALASGLNRMASTFS

SEQ ID NO: 17150 - protein, 24 aa, Brucella spp.
MASTFSMVVVLVLGAYFVTKGQMR

SEQ ID NO: 17151 - protein, 24 aa, Brucella spp.
QMRVGDVIAFIGFAQLMIGRLDQI

SEQ ID NO: 17152 - protein, 18 aa, Brucella spp.
GRFSDLLRAGGLKLEDKQ

SEQ ID NO: 17153 - protein, 17 aa, Brucella spp.
PVVEGSNVMPFPVKGAV

SEQ ID NO: 17154 - protein, 17 aa, Brucella spp.
IESLGFRIGSVVYCTDV

SEQ ID NO: 17155 - protein, 21 aa, Brucella spp.
KDADVLIIGALQYRPHPSHFS

SEQ ID NO: 17156 - protein, 25 aa, Brucella spp.
PHPSHFSLGEALEWIEKLSPKRAIL

SEQ ID NO: 17157 - protein, 29 aa, Brucella spp.
EKETEKGAFPFILHCFSSGRALAEKGIEL

SEQ ID NO: 17158 - protein, 30 aa, Brucella spp.
AEKGIELGGYISFSGILTFKNSADIREVAS

SEQ ID NO: 17159 - protein, 17 aa, Brucella spp.
DNVFRLFSKMPRPAEGI

SEQ ID NO: 17160 - protein, 23 aa, Brucella spp.
EWVEEESYFFRLSAYQDKLLDLY

SEQ ID NO: 17161 - protein, 18 aa, Brucella spp.
ENNPGFIMPAERRNEIVS

SEQ ID NO: 17162 - protein, 19 aa, Brucella spp.
RWAYWPANAHIIGKDISRF

SEQ ID NO: 17163 - protein, 28 aa, Brucella spp.
GKDISRFHAVYWPAFLMSAQLPLPKRVF

SEQ ID NO: 17164 - protein, 25 aa, Brucella spp.
LPLPKRVFAHGFLFNRGEKMSKSVG

SEQ ID NO: 17165 - protein, 24 aa, Brucella spp.
LVERYGLDQLRYFLMREVPFGQDG

SEQ ID NO: 17166 - protein, 19 aa, Brucella spp.
QALHLALGAIFAVVAEANR

SEQ ID NO: 17167 - protein, 17 aa, Brucella spp.
LALGAIFAVVAEANRYF

SEQ ID NO: 17168 - protein, 19 aa, Brucella spp.
NRYFAGQEPWALRKTDPAR

SEQ ID NO: 17169 - protein, 17 aa, Brucella spp.
GQEPWALRKTDPARMGT

SEQ ID NO: 17170 - protein, 19 aa, Brucella spp.
EVLRRVGIMVQPFIPQSAE

SEQ ID NO: 17171 - protein, 17 aa, Brucella spp.
GHDEIARFLAQAYHEGR

SEQ ID NO: 17172 - protein, 19 aa, Brucella spp.
TLAFHLAGHMLSFGDRNEA

SEQ ID NO: 17173 - protein, 21 aa, Brucella spp.
PETLIAPDFSKPLWRQIAGGM

SEQ ID NO: 17174 - protein, 17 aa, Brucella spp.
SDHAWRIVIVDPADDMN

SEQ ID NO: 17175 - protein, 23 aa, Brucella spp.
TLEEPPARALFILISHSSGRLLP

SEQ ID NO: 17176 - protein, 22 aa, Brucella spp.
IFDLPKAQALGGILNGREAEVQ

SEQ ID NO: 17177 - protein, 21 aa, Brucella spp.
EADQWARFWSDLIRETVEAET

SEQ ID NO: 17178 - protein, 25 aa, Brucella spp.
GPYEYDRVIDLSWKAAEMLDYQHHG

SEQ ID NO: 17179 - protein, 20 aa, Brucella spp.
EGNDDAFLLASYRPGGGDTI

SEQ ID NO: 17180 - protein, 17 aa, Brucella spp.
LLASYRPGGGDTIGQPA

SEQ ID NO: 17181 - protein, 24 aa, Brucella spp.
EGEYIELGLFPSLAAAKKLESALP

SEQ ID NO: 17182 - protein, 18 aa, Brucella spp.
GPARALKMLQKVVGVDQD

SEQ ID NO: 17183 - protein, 27 aa, Brucella spp.
INELCDARLAWLKGLGTFSTFGKGWTS

SEQ ID NO: 17184 - protein, 18 aa, Brucella spp.
KNPEAWGPLGGMITGVGA

SEQ ID NO: 17185 - protein, 24 aa, Brucella spp.
DGSGPMQWALAIAMVALVGVGLYF

SEQ ID NO: 17186 - protein, 25 aa, Brucella spp.
FVAEWLSLRSYWGIFLGAAAIAVVT

SEQ ID NO: 17187 - protein, 31 aa, Brucella spp.
TILLAVPIAIAFTALIGLLFARRLIRRVIRS

SEQ ID NO: 17188 - protein, 23 aa, Brucella spp.
QKDIKVWYVPAMFWPEVANIKSK

SEQ ID NO: 17189 - protein, 25 aa, Brucella spp.
DGRMPEYLKGFRFDDVPFFFYSSQL

SEQ ID NO: 17190 - protein, 25 aa, Brucella spp.
TPTNFEGGFPFTFSEAYSVGTPSIM

SEQ ID NO: 17191 - protein, 19 aa, Brucella spp.
ADSDLWLVVSYSVEYPIAP

SEQ ID NO: 17192 - protein, 25 aa, Brucella spp.
YPIAPIRPTLIFATDFIQRYVPDII

SEQ ID NO: 17193 - protein, 23 aa, Brucella spp.
PGEGDAEALAFLRQSDGVLATTP

SEQ ID NO: 17194 - protein, 18 aa, Brucella spp.
YLAPMEFDPTFLDRYRSV

SEQ ID NO: 17195 - protein, 18 aa, Brucella spp.
KEPYFLWPTNPNAHKNHA

SEQ ID NO: 17196 - protein, 24 aa, Brucella spp.
EYAELLASACFLWHPTLADNGTFA

SEQ ID NO: 17197 - protein, 22 aa, Brucella spp.
LLPSRETLSLHSWEAHASEYWD

SEQ ID NO: 17198 - protein, 25 aa, Brucella spp.
AGYLMPGMALLCIDTGTELRLLSYG

SEQ ID NO: 17199 - protein, 18 aa, Brucella spp.
GTGYDVGLAVEFATETQA

SEQ ID NO: 17200 - protein, 18 aa, Brucella spp.
GFFSLKDFATTVIDNGSN

SEQ ID NO: 17201 - protein, 23 aa, Brucella spp.
SKIKRVGAIGRFLLRANHINIGD

SEQ ID NO: 17202 - protein, 25 aa, Brucella spp.
TPYVWDILIRNVYAFGCRGRGIRMR

SEQ ID NO: 17203 - protein, 29 aa, Brucella spp.
CRGRGIRMRDGFAFLRFEDVEIGLGPQYG

SEQ ID NO: 17204 - protein, 19 aa, Brucella spp.
RFEDVEIGLGPQYGGVSLP

SEQ ID NO: 17205 - protein, 24 aa, Brucella spp.
VSLPAYEFRNFEGLFLRRTEATGL

SEQ ID NO: 17206 - protein, 18 aa, Brucella spp.
DAEQRGFIFADGAALHIN

SEQ ID NO: 17207 - protein, 18 aa, Brucella spp.
GGTGFNFINVDRININTI

SEQ ID NO: 17208 - protein, 17 aa, Brucella spp.
FPDMAAKMEKAIRGRPR

SEQ ID NO: 17209 - protein, 21 aa, Brucella spp.
HDTGLFSWTYLHKLGVEKDTL

SEQ ID NO: 17210 - protein, 20 aa, Brucella spp.
DRLCSVFIEKGVRKLRLTGG

SEQ ID NO: 17211 - protein, 17 aa, Brucella spp.
LRLTGGEPLVRKNIMHL

SEQ ID NO: 17212 - protein, 17 aa, Brucella spp.
LTGGEPLVRKNIMHLIG

SEQ ID NO: 17213 - protein, 27 aa, Brucella spp.
DFNDAEIPELIRWAHGRGMDVTLIETM

SEQ ID NO: 17214 - protein, 21 aa, Brucella spp.
TGGRLGFITPMTYNFCESCNR

SEQ ID NO: 17215 - protein, 21 aa, Brucella spp.
LSRFAAFGLPAVKDIAMNHGG

SEQ ID NO: 17216 - protein, 26 aa, Brucella spp.
WLQYAEKASIFWFAKHIGFEVVNIPL

SEQ ID NO: 17217 - protein, 20 aa, Brucella spp.
LGPCDLVLVEGYKREPHKKI

SEQ ID NO: 17218 - protein, 25 aa, Brucella spp.
NDESLPVFDINAIDEIADFIEQEMA

SEQ ID NO: 17219 - protein, 31 aa, Brucella spp.
NIQPWCVSRQLWWGHQIPAWYGPDSHCFVEK

SEQ ID NO: 17220 - protein, 23 aa, Brucella spp.
DVLDTWFSSALWPFSTLGWPDKT

SEQ ID NO: 17221 - protein, 28 aa, Brucella spp.
SVLVTGFDILFFWVARMMMMGLHFMEEI

SEQ ID NO: 17222 - protein, 23 aa, Brucella spp.
EEIPFHTVYLHALVRDKHGAKMS

SEQ ID NO: 17223 - protein, 32 aa, Brucella spp.
AAYRFVWNQFCDWYLEFLKPIFMGDDEAAKAE

SEQ ID NO: 17224 - protein, 20 aa, Brucella spp.
CLDQVYKLLHPFMPFMTEEL

SEQ ID NO: 17225 - protein, 24 aa, Brucella spp.
LHPFMPFMTEELWSLTASEGKKRD

SEQ ID NO: 17226 - protein, 21 aa, Brucella spp.
AADINWLVDLVTGIRSVRAEM

SEQ ID NO: 17227 - protein, 18 aa, Brucella spp.
MLLGEATICIPLGSLIDL

SEQ ID NO: 17228 - protein, 22 aa, Brucella spp.
GEATICIPLGSLIDLQAEAARL

SEQ ID NO: 17229 - protein, 17 aa, Brucella spp.
VAAAVLLSGTVLTGQAA

SEQ ID NO: 17230 - protein, 19 aa, Brucella spp.
YRPQITGSYNISRGKTPAT

SEQ ID NO: 17231 - protein, 20 aa, Brucella spp.
AYMDVYQLRQIAALREKNLA

SEQ ID NO: 17232 - protein, 25 aa, Brucella spp.
NVKAKEGALLPTIGLTASASQLDTI

SEQ ID NO: 17233 - protein, 25 aa, Brucella spp.
NTASIGVGVSIPIYTGGRTSAQIRQ

SEQ ID NO: 17234 - protein, 23 aa, Brucella spp.
FIAPEAVLFLLGTQMDFEVTTLR

SEQ ID NO: 17235 - protein, 20 aa, Brucella spp.
FEVTTLRTGFVFNNPNQTSA

SEQ ID NO: 17236 - protein, 23 aa, Brucella spp.
INHRLNVALLIGGVSFEEQERKL

SEQ ID NO: 17237 - protein, 18 aa, Brucella spp.
MLDMGFIPDIERICKLIP

SEQ ID NO: 17238 - protein, 22 aa, Brucella spp.
MGFIPDIERICKLIPFTRQTLF

SEQ ID NO: 17239 - protein, 26 aa, Brucella spp.
RICKLIPFTRQTLFFSATMPPEITKL

SEQ ID NO: 17240 - protein, 21 aa, Brucella spp.
EGDSLKNAIIFCNRKKDVSEL

SEQ ID NO: 17241 - protein, 23 aa, Brucella spp.
LDIPDVSHVFNFDVPIHAEDYVH

SEQ ID NO: 17242 - protein, 17 aa, Brucella spp.
QMETIRPLVMVAETDDA

SEQ ID NO: 17243 - protein, 18 aa, Brucella spp.
INEVSLFRQSYQAARIRI

SEQ ID NO: 17244 - protein, 19 aa, Brucella spp.
EAPLLALTPVSPFRPRRWG

SEQ ID NO: 17245 - protein, 28 aa, Brucella spp.
PVSPFRPRRWGGALLPKHVTVRMDLLET

SEQ ID NO: 17246 - protein, 19 aa, Brucella spp.
IRRDFPILSRQVHGKTLVY

SEQ ID NO: 17247 - protein, 24 aa, Brucella spp.
MEHHSNIVPWHFIRERQGAKLVFT

SEQ ID NO: 17248 - protein, 17 aa, Brucella spp.
DDNGVFHIEEFEKRLSE

SEQ ID NO: 17249 - protein, 25 aa, Brucella spp.
VDVQDLGCDWYVFTGHKVYGPSGIG

SEQ ID NO: 17250 - protein, 19 aa, Brucella spp.
EAGTPPIVQAIGLGAALEY

SEQ ID NO: 17251 - protein, 17 aa, Brucella spp.
VQAIGLGAALEYMEKIG

SEQ ID NO: 17252 - protein, 19 aa, Brucella spp.
GRINSLRIFGNAPDKGAII

SEQ ID NO: 17253 - protein, 23 aa, Brucella spp.
NAPDKGAIISFALEGIHAHDVSM

SEQ ID NO: 17254 - protein, 17 aa, Brucella spp.
QPLLKRFGVTSTCRASF

SEQ ID NO: 17255 - protein, 18 aa, Brucella spp.
TPAESVLIDSFAERMGDL

SEQ ID NO: 17256 - protein, 19 aa, Brucella spp.
LKVQGLPSRRIESWHYTDF

SEQ ID NO: 17257 - protein, 19 aa, Brucella spp.
SRRIESWHYTDFRTLLKGV

SEQ ID NO: 17258 - protein, 24 aa, Brucella spp.
QGHTRFPVRIGANVKGTIIERQNG

SEQ ID NO: 17259 - protein, 26 aa, Brucella spp.
TVGDGAQIIWVILRDFGQATQLSQFN

SEQ ID NO: 17260 - protein, 25 aa, Brucella spp.
ATVAELSRDYLFYLMARGIPENEAR

SEQ ID NO: 17261 - protein, 25 aa, Brucella spp.
PENEARGLLIKAFIAEIIEELEDET

SEQ ID NO: 17262 - protein, 38 aa, Brucella spp.
AERAAKGIFLAFQYPMEIPGVATMEFLKVAMNSQRKAR

SEQ ID NO: 17263 - protein, 22 aa, Brucella spp.
GEPELNIPEFIKRVKDAAGGLN

SEQ ID NO: 17264 - protein, 17 aa, Brucella spp.
MNMLKRPLNVGFSGGEK

SEQ ID NO: 17265 - protein, 19 aa, Brucella spp.
PDRAVIVITHYQRLLEHIV

SEQ ID NO: 17266 - protein, 17 aa, Brucella spp.
DAIIAALGITGNPSSVH

SEQ ID NO: 17267 - protein, 19 aa, Brucella spp.
TEHPCMIAGGQFSPDDITV

SEQ ID NO: 17268 - protein, 27 aa, Brucella spp.
VDANGILRLDILRGLLAAHDRSKGLPL

SEQ ID NO: 17269 - protein, 18 aa, Brucella spp.
DLMMPRALVRGGGQEKGH

SEQ ID NO: 17270 - protein, 24 aa, Brucella spp.
AGTEALPLIAGFGAAADVAKARID

SEQ ID NO: 17271 - protein, 20 aa, Brucella spp.
SAVPRLPNTTFFSLQGQKAE

SEQ ID NO: 17272 - protein, 18 aa, Brucella spp.
LPNTTFFSLQGQKAETVQ

SEQ ID NO: 17273 - protein, 18 aa, Brucella spp.
ETVDRFLEALRKIVERHQ

SEQ ID NO: 17274 - protein, 17 aa, Brucella spp.
IVYDLFYMFQQRGFTTL

SEQ ID NO: 17275 - protein, 17 aa, Brucella spp.
YDLFYMFQQRGFTTLRF

SEQ ID NO: 17276 - protein, 30 aa, Brucella spp.
DSKTCWVAGYSFGAWIGMQLLMRRPEIEGF

SEQ ID NO: 17277 - protein, 22 aa, Brucella spp.
ARETGIPVVYDMRAEDMRHGGQ

SEQ ID NO: 17278 - protein, 24 aa, Brucella spp.
GGQGAPLIPAYHAALAANLPLGLK

SEQ ID NO: 17279 - protein, 26 aa, Brucella spp.
AANLPLGLKGPVVFVNIGGISNLTYV

SEQ ID NO: 17280 - protein, 19 aa, Brucella spp.
PAKGELNLADGARTLAFVS

SEQ ID NO: 17281 - protein, 24 aa, Brucella spp.
MEAEAWAYLAVRSLCGLPLTYPST

SEQ ID NO: 17282 - protein, 34 aa, Brucella spp.
RCSHALLSICILLVLLGGVGFVILRGGVNSDLLR

SEQ ID NO: 17283 - protein, 17 aa, Brucella spp.
KSVRLGLAPLPLLTGKL

SEQ ID NO: 17284 - protein, 17 aa, Brucella spp.
GLAPLPLLTGKLRVAQL

SEQ ID NO: 17285 - protein, 25 aa, Brucella spp.
AFDLPEARGGGFWKSLPYDEKGYVD

SEQ ID NO: 17286 - protein, 19 aa, Brucella spp.
DAASGEIFAAMRRSLELLS

SEQ ID NO: 17287 - protein, 25 aa, Brucella spp.
DRGKIAITGTVVWKGRKIALDGDIE

SEQ ID NO: 17288 - protein, 20 aa, Brucella spp.
ELDAYAQLTLSGFAADGDKP

SEQ ID NO: 17289 - protein, 23 aa, Brucella spp.
SHKIEIKPSRLVLGGLQAQFNGA

SEQ ID NO: 17290 - protein, 24 aa, Brucella spp.
ESSDPPLSFATRIAGRYMPAQQRI

SEQ ID NO: 17291 - protein, 25 aa, Brucella spp.
DGSPEMIFMLRIPKMPVADAKHLWP

SEQ ID NO: 17292 - protein, 43 aa, Brucella spp.
IPKMPVADAKHLWPIDVADGAREWVLKNLFGGTLQDSRIDISL

SEQ ID NO: 17293 - protein, 19 aa, Brucella spp.
GTLVIPWGPQRPVMADLDL

SEQ ID NO: 17294 - protein, 25 aa, Brucella spp.
PPGTLKWNADIGFSELDIAKPVGGS

SEQ ID NO: 17295 - protein, 28 aa, Brucella spp.
ADLLKTQIDLPWLGWRKGAGIPAKATFD

SEQ ID NO: 17296 - protein, 18 aa, Brucella spp.
KGAGIPAKATFDLVEHSD

SEQ ID NO: 17297 - protein, 19 aa, Brucella spp.
EFEISNLVFSGDAFGAKGN

SEQ ID NO: 17298 - protein, 25 aa, Brucella spp.
QSNDAGAVLRFFDFYDKMRGGKITV

SEQ ID NO: 17299 - protein, 17 aa, Brucella spp.
TFMPAYGVNRIFGEVPI

SEQ ID NO: 17300 - protein, 29 aa, Brucella spp.
AYGVNRIFGEVPIFGALLGNGRDRGLLGI

SEQ ID NO: 17301 - protein, 23 aa, Brucella spp.
SSLKGHPVVVYFYPKDDTSGCTR

SEQ ID NO: 17302 - protein, 20 aa, Brucella spp.
DRVALEAYGVWVEKSMYGRK

SEQ ID NO: 17303 - protein, 28 aa, Brucella spp.
TESQDWASMLLRMYTRWAERNGRKVEVM

SEQ ID NO: 17304 - protein, 24 aa, Brucella spp.
LKTESGVHRLVRISPYDSNARRHT

SEQ ID NO: 17305 - protein, 26 aa, Brucella spp.
NARRHTSFASIWVYPVIDDNIEVQVT

SEQ ID NO: 17306 - protein, 22 aa, Brucella spp.
REKAWSMLRARLYEEELKKREE

SEQ ID NO: 17307 - protein, 25 aa, Brucella spp.
NATKTDIGWGHQIRSYVLQPYQLVK

SEQ ID NO: 17308 - protein, 23 aa, Brucella spp.
TPFMEAALAHRIQGGGEMIEDID

SEQ ID NO: 17309 - protein, 23 aa, Brucella spp.
KKQLKGNIYLARVTRVEPSLQAA

SEQ ID NO: 17310 - protein, 20 aa, Brucella spp.
VEPSLQAAFVEYGGNRHGFL

SEQ ID NO: 17311 - protein, 18 aa, Brucella spp.
GNRHGFLAFSEIHPDYYQ

SEQ ID NO: 17312 - protein, 17 aa, Brucella spp.
HGFLAFSEIHPDYYQIP

SEQ ID NO: 17313 - protein, 18 aa, Brucella spp.
EIHPDYYQIPVADRLALL

SEQ ID NO: 17314 - protein, 25 aa, Brucella spp.
PDYYQIPVADRLALLEAEAKAARAE

SEQ ID NO: 17315 - protein, 23 aa, Brucella spp.
KDLPAAEPVGPGFADYVAGTPAA

SEQ ID NO: 17316 - protein, 23 aa, Brucella spp.
IQEVIKRRQILLVQVVKEERGNK

SEQ ID NO: 17317 - protein, 31 aa, Brucella spp.
KGAALTTYLSLAGRYSVLMPNTARGGGISRK

SEQ ID NO: 17318 - protein, 20 aa, Brucella spp.
PNTARGGGISRKITNPQDRK

SEQ ID NO: 17319 - protein, 24 aa, Brucella spp.
VKELEVPQGMGVILRTAGANRTKA

SEQ ID NO: 17320 - protein, 27 aa, Brucella spp.
VKRDYEYLMRLWENVRTLTLQSTAPAL

SEQ ID NO: 17321 - protein, 20 aa, Brucella spp.
EGSLIKRSIRDIYNKDITEI

SEQ ID NO: 17322 - protein, 19 aa, Brucella spp.
YREAKDFMRMLMPSHAKVV

SEQ ID NO: 17323 - protein, 21 aa, Brucella spp.
YRDHIPIFTRNGVEAQLDRML

SEQ ID NO: 17324 - protein, 26 aa, Brucella spp.
IFTRNGVEAQLDRMLVPQVTLKSGGY

SEQ ID NO: 17325 - protein, 30 aa, Brucella spp.
EVARQLRLRDLAGLIVVDFIDMEEKRNNRA

SEQ ID NO: 17326 - protein, 25 aa, Brucella spp.
IQVGRISHFGLLEMSRQRIRASVLE

SEQ ID NO: 17327 - protein, 26 aa, Brucella spp.
RSDSSMALHIIRGIEDYLLRHSGFDI

SEQ ID NO: 17328 - protein, 25 aa, Brucella spp.
IHVRTPAASALYVLNHKRQILADLE

SEQ ID NO: 17329 - protein, 19 aa, Brucella spp.
ADLEGRFGVEISIDADESV

SEQ ID NO: 17330 - protein, 21 aa, Brucella spp.
IPDPEFVGYTPVLPVKAEESI

SEQ ID NO: 17331 - protein, 21 aa, Brucella spp.
PAKTLSFLNLIRRFVAASGAI

SEQ ID NO: 17332 - protein, 19 aa, Brucella spp.
ARTMAIIGMLLGVGAGVAG

SEQ ID NO: 17333 - protein, 21 aa, Brucella spp.
SNEMAMRSLLNYQRTEEMTAD

SEQ ID NO: 17334 - protein, 19 aa, Brucella spp.
LETFQRFASALSLSGTQID

SEQ ID NO: 17335 - protein, 25 aa, Brucella spp.
KSPLLRMSYGRALMLTGTKANMPAA

SEQ ID NO: 17336 - protein, 24 aa, Brucella spp.
ASDPEFPDGYSYLAQAYGQQGDMA

SEQ ID NO: 17337 - protein, 20 aa, Brucella spp.
GDVTVYEFFDYNCGYCKRAL

SEQ ID NO: 17338 - protein, 18 aa, Brucella spp.
NVRYVLKEFPILGPDSMR

SEQ ID NO: 17339 - protein, 23 aa, Brucella spp.
YVLKEFPILGPDSMRAHVVSQAF

SEQ ID NO: 17340 - protein, 18 aa, Brucella spp.
EFHEMLLGGHGRATEESA

SEQ ID NO: 17341 - protein, 21 aa, Brucella spp.
MKDPAITGAFQRTYQLAQQLN

SEQ ID NO: 17342 - protein, 20 aa, Brucella spp.
ELVPGAIGIDGLRQRIAAAR

SEQ ID NO: 17343 - protein, 17 aa, Brucella spp.
IGIDGLRQRIAAARDAA

SEQ ID NO: 17344 - protein, 18 aa, Brucella spp.
REPGIYGVATLDDIEASC

SEQ ID NO: 17345 - protein, 21 aa, Brucella spp.
EGYLLGLRALAAIAKEEENNG

SEQ ID NO: 17346 - protein, 23 aa, Brucella spp.
TGADAIHPGYGFLSENAKFAEIL

SEQ ID NO: 17347 - protein, 20 aa, Brucella spp.
FAEILEAHDITFIGPTASHI

SEQ ID NO: 17348 - protein, 25 aa, Brucella spp.
ARIAKEIGYPVIIKASAGGGGRGMK

SEQ ID NO: 17349 - protein, 18 aa, Brucella spp.
RAAQIALITVLAGMGSLH

SEQ ID NO: 17350 - protein, 24 aa, Brucella spp.
ITLDRKIRRIFTGWMFADSPGLNA

SEQ ID NO: 17351 - protein, 17 aa, Brucella spp.
IFTGWMFADSPGLNAVE

SEQ ID NO: 17352 - protein, 19 aa, Brucella spp.
EGRTRRWVIFNGYSEASTI

SEQ ID NO: 17353 - protein, 18 aa, Brucella spp.
STIPPGWHGWMHHRVDTP

SEQ ID NO: 17354 - protein, 18 aa, Brucella spp.
PKRFISGATGDWEVVIGM

SEQ ID NO: 17355 - protein, 17 aa, Brucella spp.
ATGDWEVVIGMEVHAQV

SEQ ID NO: 17356 - protein, 22 aa, Brucella spp.
AAMPGMLPVINLECVRQAVRTG

SEQ ID NO: 17357 - protein, 19 aa, Brucella spp.
PDLPQGYQISQFKQPIVGE

SEQ ID NO: 17358 - protein, 18 aa, Brucella spp.
PIVGEGKIMISVGPDNKG

SEQ ID NO: 17359 - protein, 19 aa, Brucella spp.
GVALMEIVSKPDLRSSDEA

SEQ ID NO: 17360 - protein, 18 aa, Brucella spp.
KNVNSIRFVGQAIEYEAR

SEQ ID NO: 17361 - protein, 30 aa, Brucella spp.
YRYFPDPDLLPLEFDQAFVDALAAKLPELP

SEQ ID NO: 17362 - protein, 19 aa, Brucella spp.
SPAQLGAIIDLIKEGTISG

SEQ ID NO: 17363 - protein, 23 aa, Brucella spp.
QAKAKPTLAGWFVGQVMKATGGK

SEQ ID NO: 17364 - protein, 23 aa, Brucella spp.
EGLKREIKVVVPAGDLEAKLAER

SEQ ID NO: 17365 - protein, 17 aa, Brucella spp.
TARGRARINGFRPGKVP

SEQ ID NO: 17366 - protein, 20 aa, Brucella spp.
RGRARINGFRPGKVPTAHLR

SEQ ID NO: 17367 - protein, 40 aa, Brucella spp.
EKVLDGKADFVFSLNYEVLPAIEVKDFSKIAVTREVVDIS

SEQ ID NO: 17368 - protein, 20 aa, Brucella spp.
SGQFIPGFEEQLIGLKAGDE

SEQ ID NO: 17369 - protein, 31 aa, Brucella spp.
AGDEKVITVTFPAEYGAAHLAGKEATFDIKV

SEQ ID NO: 17370 - protein, 18 aa, Brucella spp.
AKKLGIESLERLRQVVRE

SEQ ID NO: 17371 - protein, 17 aa, Brucella spp.
LGIESLERLRQVVREQI

SEQ ID NO: 17372 - protein, 19 aa, Brucella spp.
RQILDALDGDYQFETPQKL

SEQ ID NO: 17373 - protein, 18 aa, Brucella spp.
WQQINFDLQQAGRTFEDE

SEQ ID NO: 17374 - protein, 25 aa, Brucella spp.
KLAERRVRLGLVLSEIGEKAGVEVT

SEQ ID NO: 17375 - protein, 19 aa, Brucella spp.
PGQEKEIYDFLRRTPDAVA

SEQ ID NO: 17376 - protein, 17 aa, Brucella spp.
EIYDFLRRTPDAVANLR

SEQ ID NO: 17377 - protein, 23 aa, Brucella spp.
VLHAEMRLAGSLIMACADAHQVP

SEQ ID NO: 17378 - protein, 17 aa, Brucella spp.
EEITGLPPTEWGTTIIA

SEQ ID NO: 17379 - protein, 18 aa, Brucella spp.
LPPTEWGTTIIATGPLTA

SEQ ID NO: 17380 - protein, 17 aa, Brucella spp.
FFDAIAPIIHFDSINMD

SEQ ID NO: 17381 - protein, 17 aa, Brucella spp.
DAIAPIIHFDSINMDVC

SEQ ID NO: 17382 - protein, 19 aa, Brucella spp.
SINMDVCWFQSRYDKVGPG

SEQ ID NO: 17383 - protein, 21 aa, Brucella spp.
KEWEGTPYFDGCLPIEVMAER

SEQ ID NO: 17384 - protein, 21 aa, Brucella spp.
YFDGCLPIEVMAERGPETLRH

SEQ ID NO: 17385 - protein, 19 aa, Brucella spp.
FQTKLKYGSQTGIFKMIPG

SEQ ID NO: 17386 - protein, 22 aa, Brucella spp.
IPGLENAEFARLGGLHRNTYLN

SEQ ID NO: 17387 - protein, 18 aa, Brucella spp.
EFARLGGLHRNTYLNSPV

SEQ ID NO: 17388 - protein, 18 aa, Brucella spp.
KSRQTLRFAGQVTGCEGY

SEQ ID NO: 17389 - protein, 19 aa, Brucella spp.
VESSAIGLLAGRFTAAEKL

SEQ ID NO: 17390 - protein, 20 aa, Brucella spp.
QPMNVNFGLFPPVDVPKPEG

SEQ ID NO: 17391 - protein, 29 aa, Brucella spp.
PDMLMSILPFILIFVIMYFLIIRPQRTQM

SEQ ID NO: 17392 - protein, 17 aa, Brucella spp.
LDAADCFVWAPERLVLD

SEQ ID NO: 17393 - protein, 17 aa, Brucella spp.
AADCFVWAPERLVLDPV

SEQ ID NO: 17394 - protein, 25 aa, Brucella spp.
FAKGFPANNVLLWGARGMGKSSLVK

SEQ ID NO: 17395 - protein, 17 aa, Brucella spp.
AEFPDITPLKLVEIHRE

SEQ ID NO: 17396 - protein, 18 aa, Brucella spp.
FPDITPLKLVEIHREDID

SEQ ID NO: 17397 - protein, 19 aa, Brucella spp.
DIDSLPVLMNLIKETRHRF

SEQ ID NO: 17398 - protein, 18 aa, Brucella spp.
RHRFILFCDDLSFDHDDT

SEQ ID NO: 17399 - protein, 24 aa, Brucella spp.
VSLSDRFGLWLGFHKCSQDDYLAM

SEQ ID NO: 17400 - protein, 26 aa, Brucella spp.
LMEAGWPEGVLLNLNFPNCAPEEVKG

SEQ ID NO: 17401 - protein, 26 aa, Brucella spp.
RRDGRGFPYFWLHFGRGKAPVADDSD

SEQ ID NO: 17402 - protein, 23 aa, Brucella spp.
ELRRRLIWAILAFFVAFIFCFAF

SEQ ID NO: 17403 - protein, 18 aa, Brucella spp.
TAFLPFLIASPILFLIGG

SEQ ID NO: 17404 - protein, 27 aa, Brucella spp.
RGVHFVKVGSGWAFRTAPDLAFIMNRE

SEQ ID NO: 17405 - protein, 17 aa, Brucella spp.
FRTAPDLAFIMNRETVQ

SEQ ID NO: 17406 - protein, 20 aa, Brucella spp.
RATMEVLAIIAYHQPVTRAE

SEQ ID NO: 17407 - protein, 24 aa, Brucella spp.
DHFGLPEIRDLPGLEELRGAGLLS

SEQ ID NO: 17408 - protein, 25 aa, Brucella spp.
GAGLLSARIPSSFAVPIPNIDPDEL

SEQ ID NO: 17409 - protein, 22 aa, Brucella spp.
QGFEGPLDLLLHLARNQRVDLA

SEQ ID NO: 17410 - protein, 23 aa, Brucella spp.
LELAADYLVMAAWLAYLKSKLLI

SEQ ID NO: 17411 - protein, 18 aa, Brucella spp.
VASLQFRLKRLEAMRDAA

SEQ ID NO: 17412 - protein, 19 aa, Brucella spp.
RGMPEMVVVDRASRFSATL

SEQ ID NO: 17413 - protein, 28 aa, Brucella spp.
PVHEDDPLMELSRIMDFDTPADDNVARN

SEQ ID NO: 17414 - protein, 25 aa, Brucella spp.
EEDAFAAALEEEFDLDLGSAEAAPS

SEQ ID NO: 17415 - protein, 25 aa, Brucella spp.
GSAEAAPSPEIFEFEDVDRSEPVPQ

SEQ ID NO: 17416 - protein, 23 aa, Brucella spp.
EQNDWPAQNNWNAQQPVDAPATH

SEQ ID NO: 17417 - protein, 19 aa, Brucella spp.
LSLEDELENLLFGDEPQPV

SEQ ID NO: 17418 - protein, 25 aa, Brucella spp.
GEAPAYPYYPRSNFAPGVAAPGVLS

SEQ ID NO: 17419 - protein, 20 aa, Brucella spp.
RSNFAPGVAAPGVLSSGPQL

SEQ ID NO: 17420 - protein, 17 aa, Brucella spp.
KTPQAPIVQDFVAQDPF

SEQ ID NO: 17421 - protein, 25 aa, Brucella spp.
PIVQDFVAQDPFRPIEDEFSLEDDF

SEQ ID NO: 17422 - protein, 25 aa, Brucella spp.
PIEDEFSLEDDFTFEAEPETAAAAE

SEQ ID NO: 17423 - protein, 26 aa, Brucella spp.
HSGEDYRPAVSFAAYTDMQAPARMPA

SEQ ID NO: 17424 - protein, 24 aa, Brucella spp.
SELEAEFAEVFSTIGVDENVQITE

SEQ ID NO: 17425 - protein, 19 aa, Brucella spp.
FYNHWAAQGAQTMEGGDYG

SEQ ID NO: 17426 - protein, 24 aa, Brucella spp.
AYRNRPVRGRRGLILASVAGVAVL

SEQ ID NO: 17427 - protein, 26 aa, Brucella spp.
AGVAVLLGGIGYHFLGGGGSGEPVVI

SEQ ID NO: 17428 - protein, 23 aa, Brucella spp.
PETPRLPTRAPIVPSRPAEQPVN

SEQ ID NO: 17429 - protein, 17 aa, Brucella spp.
AEQPVNIVGNVPQRAQA

SEQ ID NO: 17430 - protein, 19 aa, Brucella spp.
VDVAGPGFINLRLKASYWQ

SEQ ID NO: 17431 - protein, 21 aa, Brucella spp.
VLANLLKFAGYDVVKEYYIND

SEQ ID NO: 17432 - protein, 23 aa, Brucella spp.
GEIPAGLYPGDYLVRVGQELAGE

SEQ ID NO: 17433 - protein, 24 aa, Brucella spp.
LLEMPEAEALAIVKDRTIDAMMAM

SEQ ID NO: 17434 - protein, 20 aa, Brucella spp.
KSDGSFTYFAGDVAYFKDKY

SEQ ID NO: 17435 - protein, 20 aa, Brucella spp.
YDHGFNEMIYVLGADHGGYV

SEQ ID NO: 17436 - protein, 23 aa, Brucella spp.
AKLTVLLCQLVKLFRNGEPVRMS

SEQ ID NO: 17437 - protein, 22 aa, Brucella spp.
YRKNDAPLDFDFAKVTEQSKDN

SEQ ID NO: 17438 - protein, 18 aa, Brucella spp.
IALVRKLAEYPRLIESAA

SEQ ID NO: 17439 - protein, 20 aa, Brucella spp.
PHRLAFYLYDLASSFHSQWN

SEQ ID NO: 17440 - protein, 17 aa, Brucella spp.
YDLASSFHSQWNRGAEN

SEQ ID NO: 17441 - protein, 17 aa, Brucella spp.
VEGGGCSGFSYKYDLVD

SEQ ID NO: 17442 - protein, 23 aa, Brucella spp.
GGGCSGFSYKYDLVDAQTEDDIV

SEQ ID NO: 17443 - protein, 19 aa, Brucella spp.
SPFELFKFGFSAYKNGHKD

SEQ ID NO: 17444 - protein, 17 aa, Brucella spp.
AKWKLARMYAEGDGVAE

SEQ ID NO: 17445 - protein, 20 aa, Brucella spp.
NAVQAARWFQLAARKGNTGA

SEQ ID NO: 17446 - protein, 22 aa, Brucella spp.
FAAMPQLEFILVVGQYALAYHL

SEQ ID NO: 17447 - protein, 20 aa, Brucella spp.
WFDMEVVPVLQAKVRHLIDD

SEQ ID NO: 17448 - protein, 25 aa, Brucella spp.
SLGRLEEIVAWLATWTGKRTPQVNR

SEQ ID NO: 17449 - protein, 21 aa, Brucella spp.
ICIANDLGLKVFDLALEHPTG

SEQ ID NO: 17450 - protein, 17 aa, Brucella spp.
DERTCAATMAFGMEAIA

SEQ ID NO: 17451 - protein, 21 aa, Brucella spp.
RTCAATMAFGMEAIAGGTDLL

SEQ ID NO: 17452 - protein, 23 aa, Brucella spp.
DPLEVLRCLGGREIAAMAGAILA

SEQ ID NO: 17453 - protein, 18 aa, Brucella spp.
IAAMAGAILAARMEKIPV

SEQ ID NO: 17454 - protein, 17 aa, Brucella spp.
AILAARMEKIPVIVDGF

SEQ ID NO: 17455 - protein, 19 aa, Brucella spp.
RMEKIPVIVDGFVASAAAA

SEQ ID NO: 17456 - protein, 21 aa, Brucella spp.
MGKEPLLDLGMRLGEGTGAAL

SEQ ID NO: 17457 - protein, 18 aa, Brucella spp.
GFLSRLPLPQGWFDNTDD

SEQ ID NO: 17458 - protein, 20 aa, Brucella spp.
RNARAFPLAGGILGLLAGVA

SEQ ID NO: 17459 - protein, 19 aa, Brucella spp.
RIGTFAALTLVIWTGVKAS

SEQ ID NO: 17460 - protein, 20 aa, Brucella spp.
VKASLLMAIIARAGAGYALL

SEQ ID NO: 17461 - protein, 17 aa, Brucella spp.
VLMTVVLFGFARLCMAK

SEQ ID NO: 17462 - protein, 26 aa, Brucella spp.
NDAFARAAYLGIWGIVLAAGLLGSGI

SEQ ID NO: 17463 - protein, 19 aa, Brucella spp.
IRLGDFARNIAIWSVIILG

SEQ ID NO: 17464 - protein, 28 aa, Brucella spp.
FARNIAIWSVIILGLVAGYQYRYDLQDA

SEQ ID NO: 17465 - protein, 18 aa, Brucella spp.
GLLTGSLLGMNFLQTLGG

SEQ ID NO: 17466 - protein, 26 aa, Brucella spp.
EMRGFKRIAACAVIAGFAAIGAARAE

SEQ ID NO: 17467 - protein, 20 aa, Brucella spp.
AEEPLKLVIGTEGAYPPFNF

SEQ ID NO: 17468 - protein, 23 aa, Brucella spp.
SLSGFDVDIARALCDEMKAECTF

SEQ ID NO: 17469 - protein, 20 aa, Brucella spp.
EMKAECTFITQEWDGTIPAL

SEQ ID NO: 17470 - protein, 24 aa, Brucella spp.
DAIHGVGVGVAFKKGRPELVEKFN

SEQ ID NO: 17471 - protein, 17 aa, Brucella spp.
FKKGRPELVEKFNAAIK

SEQ ID NO: 17472 - protein, 17 aa, Brucella spp.
RVWSEWARRHGIDPVTF

SEQ ID NO: 17473 - protein, 17 aa, Brucella spp.
RHGIDPVTFLPTIHGVR

SEQ ID NO: 17474 - protein, 18 aa, Brucella spp.
IEGAYKFLHSLPENRWAI

SEQ ID NO: 17475 - protein, 21 aa, Brucella spp.
PENRWAIVTSAPLELARRRIK

SEQ ID NO: 17476 - protein, 17 aa, Brucella spp.
SPECFELGAKRLGFAPR

SEQ ID NO: 17477 - protein, 21 aa, Brucella spp.
YAPRPRVRWNPIAAVQAHDAQ

SEQ ID NO: 17478 - protein, 34 aa, Brucella spp.
RCEVSAPDCLSAFERFGSHPLVKLVSLMDHAPGQ

SEQ ID NO: 17479 - protein, 23 aa, Brucella spp.
ADIESYKAYFLRKSNFSEEEFRL

SEQ ID NO: 17480 - protein, 19 aa, Brucella spp.
IADLCHARGIILASHDDAT

SEQ ID NO: 17481 - protein, 19 aa, Brucella spp.
ASMMQSAFFLAEVVENISL

SEQ ID NO: 17482 - protein, 18 aa, Brucella spp.
FFLAEVVENISLPQAIRL

SEQ ID NO: 17483 - protein, 25 aa, Brucella spp.
EVVENISLPQAIRLVSANPARALRL

SEQ ID NO: 17484 - protein, 17 aa, Brucella spp.
ATMKAPFRLAGEHSEND

SEQ ID NO: 17485 - protein, 19 aa, Brucella spp.
ENDLLAALMHFASSAAPVV

SEQ ID NO: 17486 - protein, 25 aa, Brucella spp.
VVIPRLELQSISSFFALVPEEPVAE

SEQ ID NO: 17487 - protein, 17 aa, Brucella spp.
HNLVRWGYPYVFEEFRF

SEQ ID NO: 17488 - protein, 26 aa, Brucella spp.
VRWGYPYVFEEFRFHMTLTGPVEEKD

SEQ ID NO: 17489 - protein, 23 aa, Brucella spp.
MEGHPAPLVIGYRDFADYPAHSP

SEQ ID NO: 17490 - protein, 23 aa, Brucella spp.
PDGEMGFPGNLNVNCTYMLNADG

SEQ ID NO: 17491 - protein, 19 aa, Brucella spp.
KDTAFDFREFRPLRMQENG

SEQ ID NO: 17492 - protein, 19 aa, Brucella spp.
FDFREFRPLRMQENGRQVA

SEQ ID NO: 17493 - protein, 35 aa, Brucella spp.
AGFCLEPQIWPGALEYPYFPQPILRPGDIYAQISH

SEQ ID NO: 17494 - protein, 23 aa, Brucella spp.
HPLGEVDWSLQIPKRGDQRQMET

SEQ ID NO: 17495 - protein, 18 aa, Brucella spp.
DEALCATMDMIVGAGGGE

SEQ ID NO: 17496 - protein, 24 aa, Brucella spp.
LSTELRPTLFLAQLSNLLAGNISI

SEQ ID NO: 17497 - protein, 18 aa, Brucella spp.
DMILGAELGGLLKHDGWA

SEQ ID NO: 17498 - protein, 28 aa, Brucella spp.
ELGGLLKHDGWAALWSRDGSAGGGMISG

SEQ ID NO: 17499 - protein, 29 aa, Brucella spp.
TGHLREAQFPLALALGAISVWKGEAFAPL

SEQ ID NO: 17500 - protein, 22 aa, Brucella spp.
GAISVWKGEAFAPLDASEKPAS

SEQ ID NO: 17501 - protein, 24 aa, Brucella spp.
LWAQAVFVLLGFLRLFPAKAAISF

SEQ ID NO: 17502 - protein, 24 aa, Brucella spp.
FLRLFPAKAAISFSARVARLIGPL

SEQ ID NO: 17503 - protein, 18 aa, Brucella spp.
EVEGIPIFEGLRDEKKPH

SEQ ID NO: 17504 - protein, 25 aa, Brucella spp.
VLDDLDLILVMTVNPGFGGQKFIAP

SEQ ID NO: 17505 - protein, 29 aa, Brucella spp.
EMVAIWSPETKFRIWFEIEAYACEALAEL

SEQ ID NO: 17506 - protein, 17 aa, Brucella spp.
DVIAFLTHLAEFIGPDS

SEQ ID NO: 17507 - protein, 21 aa, Brucella spp.
EPTTMGLTFARFYAEMSRNRA

SEQ ID NO: 17508 - protein, 18 aa, Brucella spp.
RDRHAMFFATLGVIASSM

SEQ ID NO: 17509 - protein, 20 aa, Brucella spp.
TTITLDFALNRLAGVIEKLV

SEQ ID NO: 17510 - protein, 21 aa, Brucella spp.
IPHIQHKVAGAFFVAPPDVSN

SEQ ID NO: 17511 - protein, 23 aa, Brucella spp.
PRERLPFPTIMVVSRNDPFSSFE

SEQ ID NO: 17512 - protein, 17 aa, Brucella spp.
WPEGSMVFAEFMTQLQA

SEQ ID NO: 17513 - protein, 17 aa, Brucella spp.
EGSMVFAEFMTQLQAPK

SEQ ID NO: 17514 - protein, 19 aa, Brucella spp.
EGPEPGTLVQFFKDDATAF

SEQ ID NO: 17515 - protein, 18 aa, Brucella spp.
PGTLVQFFKDDATAFNAK

SEQ ID NO: 17516 - protein, 20 aa, Brucella spp.
NRIGIPTHFIRRLNMREQLI

SEQ ID NO: 17517 - protein, 23 aa, Brucella spp.
MVTEEHITAFGWASPQEIDDIMA

SEQ ID NO: 17518 - protein, 17 aa, Brucella spp.
ASPQEIDDIMALAIRVN

SEQ ID NO: 17519 - protein, 23 aa, Brucella spp.
VNDFLTGLFLGIGIQLVDFKMEC

SEQ ID NO: 17520 - protein, 24 aa, Brucella spp.
LVDFKMECGRLWEGDMMRIVVADE

SEQ ID NO: 17521 - protein, 29 aa, Brucella spp.
IPDDVDLILIPGGFSYGDYLRCGAIAARM

SEQ ID NO: 17522 - protein, 23 aa, Brucella spp.
MVMGVCNGFQILLEAGLLPGALM

SEQ ID NO: 17523 - protein, 22 aa, Brucella spp.
KRLEGEGQVVFRYAEGTNPNGS

SEQ ID NO: 17524 - protein, 17 aa, Brucella spp.
PISMTISNTRDITPELI

SEQ ID NO: 17525 - protein, 17 aa, Brucella spp.
ITPELIEAHGLKPDEYQ

SEQ ID NO: 17526 - protein, 22 aa, Brucella spp.
KPDEYQRILELIGREPTFTELG

SEQ ID NO: 17527 - protein, 26 aa, Brucella spp.
REPTFTELGIFSAMWNEHCSYKSSKK

SEQ ID NO: 17528 - protein, 17 aa, Brucella spp.
GILRDVFTMGARPVAAM

SEQ ID NO: 17529 - protein, 21 aa, Brucella spp.
MGARPVAAMNALRFGEPDHPK

SEQ ID NO: 17530 - protein, 23 aa, Brucella spp.
SEAEGVGLPVVYLGAKTSRDGVG

SEQ ID NO: 17531 - protein, 17 aa, Brucella spp.
VEMGAKGDLGIELILDH

SEQ ID NO: 17532 - protein, 19 aa, Brucella spp.
AKGDLGIELILDHVPVREE

SEQ ID NO: 17533 - protein, 17 aa, Brucella spp.
LGIELILDHVPVREENM

SEQ ID NO: 17534 - protein, 31 aa, Brucella spp.
EKEAEAQAIFRKWGLDFAIVGKTTDDLRFRV

SEQ ID NO: 17535 - protein, 21 aa, Brucella spp.
ACRALDFPIVSGNVSLYNETN

SEQ ID NO: 17536 - protein, 19 aa, Brucella spp.
TPTIAGVGLLPDWSQMAKI

SEQ ID NO: 17537 - protein, 19 aa, Brucella spp.
VGLLPDWSQMAKIGGMQDG

SEQ ID NO: 17538 - protein, 17 aa, Brucella spp.
LGQSVYLRDLFDRADGP

SEQ ID NO: 17539 - protein, 23 aa, Brucella spp.
AGDGLPHALLFGEDQARYVISAT

SEQ ID NO: 17540 - protein, 24 aa, Brucella spp.
ISATPEMAKLIALNAEGAGVPFRI

SEQ ID NO: 17541 - protein, 23 aa, Brucella spp.
EGAGVPFRILGTVGGDRLKISKN

SEQ ID NO: 17542 - protein, 17 aa, Brucella spp.
VQFVITAYLLGFGVSQL

SEQ ID NO: 17543 - protein, 23 aa, Brucella spp.
FGRRLPLFGGLAIYVVAALGSAF

SEQ ID NO: 17544 - protein, 24 aa, Brucella spp.
AFVTDFTTLIILRVLQGLGAAATR

SEQ ID NO: 17545 - protein, 25 aa, Brucella spp.
IMLFGEWHLIFMFMAIMALVVGLWA

SEQ ID NO: 17546 - protein, 22 aa, Brucella spp.
YQLGTLFPLAFAAVAMTLALAS

SEQ ID NO: 17547 - protein, 22 aa, Brucella spp.
MRRISQTMLLVFTSFSLLWMVL

SEQ ID NO: 17548 - protein, 21 aa, Brucella spp.
MDGPIPFAVLMIIYMTIMLSF

SEQ ID NO: 17549 - protein, 18 aa, Brucella spp.
ATGYCVLGFVALACVLIA

SEQ ID NO: 17550 - protein, 21 aa, Brucella spp.
GCHPLFRDVPATVEFNKLRKR

SEQ ID NO: 17551 - protein, 26 aa, Brucella spp.
SYGLLALLLDLKWRGLLPVELLAVNL

SEQ ID NO: 17552 - protein, 23 aa, Brucella spp.
PNFPKHILPDFLTRYGIEHRIEY

SEQ ID NO: 17553 - protein, 19 aa, Brucella spp.
SAIFAFGFTAAAQADAVPK

SEQ ID NO: 17554 - protein, 24 aa, Brucella spp.
YKWDSITLRCGITRGKLQAIEIVR

SEQ ID NO: 17555 - protein, 18 aa, Brucella spp.
ADRELIILNDADFTLRRG

SEQ ID NO: 17556 - protein, 24 aa, Brucella spp.
VRRNDVGFVYQFHHLLPEFSALEN

SEQ ID NO: 17557 - protein, 29 aa, Brucella spp.
LLPEFSALENVMLPQMIRGLSRKAAAERA

SEQ ID NO: 17558 - protein, 19 aa, Brucella spp.
TTSSYVFGALEALVRQSGL

SEQ ID NO: 17559 - protein, 17 aa, Brucella spp.
ALEALVRQSGLAALIAT

SEQ ID NO: 17560 - protein, 21 aa, Brucella spp.
FSAFERMIAWRYLRARRRETF

SEQ ID NO: 17561 - protein, 24 aa, Brucella spp.
RETFISVIAGFSFTGIMLGVATLI

SEQ ID NO: 17562 - protein, 20 aa, Brucella spp.
RVKAYPIVAIFEIGMSEYDS

SEQ ID NO: 17563 - protein, 18 aa, Brucella spp.
VERLREFFSWLSGTTLFN

SEQ ID NO: 17564 - protein, 17 aa, Brucella spp.
REFFSWLSGTTLFNPEL

SEQ ID NO: 17565 - protein, 20 aa, Brucella spp.
LFNPELYFLSQLPAKMDPGE

SEQ ID NO: 17566 - protein, 23 aa, Brucella spp.
EALPEHGVTVVFIDVGNTKIELL

SEQ ID NO: 17567 - protein, 18 aa, Brucella spp.
GKPVLFLHPKDFNGTLIE

SEQ ID NO: 17568 - protein, 19 aa, Brucella spp.
VFLPLGGVGEIGMNLAMYG

SEQ ID NO: 17569 - protein, 21 aa, Brucella spp.
LGGVGEIGMNLAMYGFGPADN

SEQ ID NO: 17570 - protein, 24 aa, Brucella spp.
HEDHFGALLDLWPRLKVPVYATPF

SEQ ID NO: 17571 - protein, 21 aa, Brucella spp.
WPRLKVPVYATPFIAGLLEAK

SEQ ID NO: 17572 - protein, 17 aa, Brucella spp.
PEIPITIYKAGETFEVG

SEQ ID NO: 17573 - protein, 20 aa, Brucella spp.
KMDPEPSLGPVIDEARFRAI

SEQ ID NO: 17574 - protein, 20 aa, Brucella spp.
RAIGEAGVLALICDSTNALR

SEQ ID NO: 17575 - protein, 21 aa, Brucella spp.
AISVATELGYMEGLPEYLSEE

SEQ ID NO: 17576 - protein, 17 aa, Brucella spp.
RRSELRRMYSWVRPQIL

SEQ ID NO: 17577 - protein, 17 aa, Brucella spp.
RRMYSWVRPQILVPVHG

SEQ ID NO: 17578 - protein, 25 aa, Brucella spp.
VESYEMKTAATLGFVAGLSLADALD

SEQ ID NO: 17579 - protein, 20 aa, Brucella spp.
PPTIGLKWPNDVLVNGAKLT

SEQ ID NO: 17580 - protein, 25 aa, Brucella spp.
KFDKFEFPVLIVIATLGMLLMVSAN

SEQ ID NO: 17581 - protein, 18 aa, Brucella spp.
LQSLALYVLAAFNRDSVR

SEQ ID NO: 17582 - protein, 17 aa, Brucella spp.
AGLKYFVLGSLSSGMLL

SEQ ID NO: 17583 - protein, 26 aa, Brucella spp.
GGQRELGLVFGLIFILAGLVFKISAV

SEQ ID NO: 17584 - protein, 18 aa, Brucella spp.
FYYLRMIKIMWFDEPAAG

SEQ ID NO: 17585 - protein, 24 aa, Brucella spp.
PVAGELRLVLGVTGAFVLFYVFLA

SEQ ID NO: 17586 - protein, 23 aa, Brucella spp.
AFLMPFCILASWVSVEKRVKEYM

SEQ ID NO: 17587 - protein, 23 aa, Brucella spp.
KRVKEYMIAFLILETLMIGVFCA

SEQ ID NO: 17588 - protein, 25 aa, Brucella spp.
VFCALDLFLFYVFFEASLIPMFIII

SEQ ID NO: 17589 - protein, 25 aa, Brucella spp.
FEASLIPMFIIIGVWGGKRRVYASL

SEQ ID NO: 17590 - protein, 18 aa, Brucella spp.
YASLKFFLYTLLGSVLML

SEQ ID NO: 17591 - protein, 20 aa, Brucella spp.
SMQTWLWLAFFASFAVKMPM

SEQ ID NO: 17592 - protein, 26 aa, Brucella spp.
GFIGEFLTLFGVFRVNTWVALFATTG

SEQ ID NO: 17593 - protein, 18 aa, Brucella spp.
YALWLYRKVIFGALDKES

SEQ ID NO: 17594 - protein, 20 aa, Brucella spp.
EKLILYPLVALTIFFGVYPT

SEQ ID NO: 17595 - protein, 23 aa, Brucella spp.
MVFVAILSWIVFFKIPLGHDAET

SEQ ID NO: 17596 - protein, 22 aa, Brucella spp.
RPRFFAYLSLFTFAMLMLVTSD

SEQ ID NO: 17597 - protein, 19 aa, Brucella spp.
VGLASYLLIGFWFKKPSAN

SEQ ID NO: 17598 - protein, 24 aa, Brucella spp.
NRVGDFGFLLGIFSVFALFQSVDY

SEQ ID NO: 17599 - protein, 22 aa, Brucella spp.
GAITIACLLLFMGAMGKSAQFL

SEQ ID NO: 17600 - protein, 18 aa, Brucella spp.
PPVMLVPLLILGIGAILA

SEQ ID NO: 17601 - protein, 23 aa, Brucella spp.
MVIGFVVAWIFYIRAPEMPKALA

SEQ ID NO: 17602 - protein, 28 aa, Brucella spp.
WYFDELYDFLFVRPARWLGRLFWKGGDG

SEQ ID NO: 17603 - protein, 17 aa, Brucella spp.
RLFWKGGDGWLIDGFGP

SEQ ID NO: 17604 - protein, 24 aa, Brucella spp.
GYLYHYAFAMLIGVAALVTWMMLG

SEQ ID NO: 17605 - protein, 20 aa, Brucella spp.
EAAIGLAILVVFFRNRGSIA

SEQ ID NO: 17606 - protein, 18 aa, Brucella spp.
PVHSVLFLILTFFNAAAL

SEQ ID NO: 17607 - protein, 24 aa, Brucella spp.
LTGAEFLAMILLVVYVGAVAVLFL

SEQ ID NO: 17608 - protein, 22 aa, Brucella spp.
ILLGELIFVFASRMFTPKLGQG

SEQ ID NO: 17609 - protein, 26 aa, Brucella spp.
SLLLKEFASAFALSMRQFFAPKATLN

SEQ ID NO: 17610 - protein, 18 aa, Brucella spp.
FADLLKFVFKEPIIPSGA

SEQ ID NO: 17611 - protein, 17 aa, Brucella spp.
VSYEVSIGFVIVTVLLT

SEQ ID NO: 17612 - protein, 19 aa, Brucella spp.
YEVSIGFVIVTVLLTVGSL

SEQ ID NO: 17613 - protein, 28 aa, Brucella spp.
ASFLDWNWLCLFPMFVVFFISALAETNR

SEQ ID NO: 17614 - protein, 24 aa, Brucella spp.
FMLKLCFCFFLFAMVKAFVPRYRY

SEQ ID NO: 17615 - protein, 24 aa, Brucella spp.
MRLGWKVFLPISLFMVVATATFLK

SEQ ID NO: 17616 - protein, 26 aa, Brucella spp.
AEVPRFCFHERLSIAGNCRMCLVEVK

SEQ ID NO: 17617 - protein, 25 aa, Brucella spp.
VKKAREGVMEFLLINHPLDCPICDQ

SEQ ID NO: 17618 - protein, 17 aa, Brucella spp.
KYIGPLVKTVMTRCIHC

SEQ ID NO: 17619 - protein, 18 aa, Brucella spp.
TEVAGISELGLIGRGEDA

SEQ ID NO: 17620 - protein, 21 aa, Brucella spp.
IDLCPVGALTSRPYAFQARPW

SEQ ID NO: 17621 - protein, 21 aa, Brucella spp.
WISDKTRFIWDGLRTQRLDRP

SEQ ID NO: 17622 - protein, 28 aa, Brucella spp.
DGRLVAATWPEAFAAIAAKVSATSAEKI

SEQ ID NO: 17623 - protein, 21 aa, Brucella spp.
VEEIYALKGLMTALGTANIDC

SEQ ID NO: 17624 - protein, 18 aa, Brucella spp.
AKAERPLIIIGQGALTGE

SEQ ID NO: 17625 - protein, 17 aa, Brucella spp.
AIKDDWNGFSVLHTAAS

SEQ ID NO: 17626 - protein, 25 aa, Brucella spp.
RDMLGNLDVVFLLGADELDMMAKSS

SEQ ID NO: 17627 - protein, 21 aa, Brucella spp.
GEAKEDWAILRALSDSLGKRL

SEQ ID NO: 17628 - protein, 17 aa, Brucella spp.
WAILRALSDSLGKRLPF

SEQ ID NO: 17629 - protein, 18 aa, Brucella spp.
GKRLPFDSLQQLRAKLYA

SEQ ID NO: 17630 - protein, 26 aa, Brucella spp.
RGGAGFPTGLKWSFMPKQSDGRPHYL

SEQ ID NO: 17631 - protein, 18 aa, Brucella spp.
MGVHTAYIYIRGEFMRER

SEQ ID NO: 17632 - protein, 19 aa, Brucella spp.
LKPPFPANMGLYGCPTTVN

SEQ ID NO: 17633 - protein, 24 aa, Brucella spp.
PCVVEEGLGIPFRELIEKHGGGIR

SEQ ID NO: 17634 - protein, 17 aa, Brucella spp.
GGIRGGWDNLLAVIPGG

SEQ ID NO: 17635 - protein, 19 aa, Brucella spp.
KAIARLSAFFKHESCGQCT

SEQ ID NO: 17636 - protein, 21 aa, Brucella spp.
TPCREGTGWMWRVMERMVKGN

SEQ ID NO: 17637 - protein, 22 aa, Brucella spp.
AQKREIDMLFDVTKQIEGHTIC

SEQ ID NO: 17638 - protein, 18 aa, Brucella spp.
HTICALGDAAAWPIQGLI

SEQ ID NO: 17639 - protein, 20 aa, Brucella spp.
GRQQSAVIPLLMRAQEQEGW

SEQ ID NO: 17640 - protein, 27 aa, Brucella spp.
AAMLNMPLIRVLEVATFYTQFQLKPVG

SEQ ID NO: 17641 - protein, 23 aa, Brucella spp.
HIQVCGTTPCMLRGSEALMDVCR

SEQ ID NO: 17642 - protein, 21 aa, Brucella spp.
DPFELNADGTLSWEEVECQGA

SEQ ID NO: 17643 - protein, 18 aa, Brucella spp.
APMVMIFKDAYEDLTPER

SEQ ID NO: 17644 - protein, 22 aa, Brucella spp.
LTPERLAEIIDAFEAGKGDTIK

SEQ ID NO: 17645 - protein, 21 aa, Brucella spp.
QEHAYALAVERLLDIEVPKRG

SEQ ID NO: 17646 - protein, 19 aa, Brucella spp.
VPKRGQLIRVLYSEIGRIL

SEQ ID NO: 17647 - protein, 27 aa, Brucella spp.
IGVVKLEDAWAWGFSGVMVRGSGAAWD

SEQ ID NO: 17648 - protein, 25 aa, Brucella spp.
LRAPGFAHLQAMDFLCRGHMLADVS

SEQ ID NO: 17649 - protein, 22 aa, Brucella spp.
LCVPVASLIGVLTFLRDDVQCQ

SEQ ID NO: 17650 - protein, 19 aa, Brucella spp.
RKDFPLTGFVEVRYNDELK

SEQ ID NO: 17651 - protein, 23 aa, Brucella spp.
QLRQEFRNFDFLSPWEGTDYVLP

SEQ ID NO: 17652 - protein, 17 aa, Brucella spp.
FDFLSPWEGTDYVLPGD

SEQ ID NO: 17653 - protein, 20 aa, Brucella spp.
RTGSLMWMTFGLACCAVEMM

SEQ ID NO: 17654 - protein, 17 aa, Brucella spp.
RVVPVDIYVPGCPPTAE

SEQ ID NO: 17655 - protein, 23 aa, Brucella spp.
PPTAEALLYGILLLQKKIRRTGT

SEQ ID NO: 17656 - protein, 25 aa, Brucella spp.
IIFDLEVAFLFPWAVSFGQIGWFGF

SEQ ID NO: 17657 - protein, 20 aa, Brucella spp.
AHAAFPYYALILCGRIEGRS

SEQ ID NO: 17658 - protein, 18 aa, Brucella spp.
AHLLKLGKRLAVLDISLT

SEQ ID NO: 17659 - protein, 21 aa, Brucella spp.
AEVVKKWVLIDAEGLVVGRLA

SEQ ID NO: 17660 - protein, 18 aa, Brucella spp.
LIDAEGLVVGRLASLVAN

SEQ ID NO: 17661 - protein, 18 aa, Brucella spp.
GLVVGRLASLVANRLRGK

SEQ ID NO: 17662 - protein, 17 aa, Brucella spp.
GKRKDAVARVWVKPGTG

SEQ ID NO: 17663 - protein, 20 aa, Brucella spp.
RKDAVARVWVKPGTGKITVN

SEQ ID NO: 17664 - protein, 21 aa, Brucella spp.
FEKYFARPVLQMILQQPIVAS

SEQ ID NO: 17665 - protein, 21 aa, Brucella spp.
YEPGLRTVLKKGGFLTRDSRV

SEQ ID NO: 17666 - protein, 25 aa, Brucella spp.
TTHRVHPDWAYGFAELAKGQRERIA

SEQ ID NO: 17667 - protein, 17 aa, Brucella spp.
YPTGAIALVRPLRDAGL

SEQ ID NO: 17668 - protein, 18 aa, Brucella spp.
GLLPADYPVSVNAVSGYT

SEQ ID NO: 17669 - protein, 21 aa, Brucella spp.
PDYLAANNFLYGLPLKHKHVP

SEQ ID NO: 17670 - protein, 24 aa, Brucella spp.
GRFPQGMIVQVPLFLSELEGSPSL

SEQ ID NO: 17671 - protein, 25 aa, Brucella spp.
LILDALETIYDFVLIECGPSSSVHI

SEQ ID NO: 17672 - protein, 25 aa, Brucella spp.
GMMRLVELTLIFATGILSFAYYVGL

SEQ ID NO: 17673 - protein, 26 aa, Brucella spp.
ISSQFSRGWFIIWAVSAFGVLVISRL

SEQ ID NO: 17674 - protein, 22 aa, Brucella spp.
LVISRLFIAWKIRRWARNGTME

SEQ ID NO: 17675 - protein, 25 aa, Brucella spp.
PISAELRVLSLLKKLWVLPVDIRLS

SEQ ID NO: 17676 - protein, 24 aa, Brucella spp.
GFNNEVINVWKFRSMYADKCDPAA

SEQ ID NO: 17677 - protein, 17 aa, Brucella spp.
DLAEAVYRKVGLSRTES

SEQ ID NO: 17678 - protein, 22 aa, Brucella spp.
GETVKLSSFATFQVRDKNERIG

SEQ ID NO: 17679 - protein, 24 aa, Brucella spp.
GEEVPILPRRVMTFKASNVLKQRI

SEQ ID NO: 17680 - protein, 27 aa, Brucella spp.
VAIQRELGITRGFAFDLQAVCSGFIYA

SEQ ID NO: 17681 - protein, 25 aa, Brucella spp.
FDLQAVCSGFIYAITTADLYIRGGM

SEQ ID NO: 17682 - protein, 26 aa, Brucella spp.
PLGRYEMLSLHIFLALHRMKGENPAL

SEQ ID NO: 17683 - protein, 26 aa, Brucella spp.
LEFWPHACYLGAYVLQCRDCLREISD

SEQ ID NO: 17684 - protein, 20 aa, Brucella spp.
FDNEVFYYISQKRYRAAQFM

SEQ ID NO: 17685 - protein, 18 aa, Brucella spp.
VIERQILAIYFNKDGKVE

SEQ ID NO: 17686 - protein, 25 aa, Brucella spp.
HIANYGLKDGKLFDFVSRTTPTSGK

SEQ ID NO: 17687 - protein, 20 aa, Brucella spp.
GVARLAAVQALFQMDVAGTG

SEQ ID NO: 17688 - protein, 19 aa, Brucella spp.
LDADPQWFRAIVAGVVEDQ

SEQ ID NO: 17689 - protein, 17 aa, Brucella spp.
TLRAILRAGAWELKARK

SEQ ID NO: 17690 - protein, 25 aa, Brucella spp.
ARKRPEVILKLALSADGMIGRKGAG

SEQ ID NO: 17691 - protein, 18 aa, Brucella spp.
GGLRLPLSSRLVRSADTQ

SEQ ID NO: 17692 - protein, 20 aa, Brucella spp.
RIALPELLDDLAAQGIASVL

SEQ ID NO: 17693 - protein, 25 aa, Brucella spp.
LDEKLVDRLIIFRSPLVIGAADGVA

SEQ ID NO: 17694 - protein, 19 aa, Brucella spp.
ITSEFKILRRMRYADDACA

SEQ ID NO: 17695 - protein, 17 aa, Brucella spp.
FKILRRMRYADDACAEY

SEQ ID NO: 17696 - protein, 25 aa, Brucella spp.
LKGIDDIAYIRFASVYRNFSKAVDF

SEQ ID NO: 17697 - protein, 19 aa, Brucella spp.
SRGGWPLVPGNARLQIGVN

SEQ ID NO: 17698 - protein, 17 aa, Brucella spp.
LPQEAGLSTAFDTYVDA

SEQ ID NO: 17699 - protein, 20 aa, Brucella spp.
QEAGLSTAFDTYVDAALKRF

SEQ ID NO: 17700 - protein, 19 aa, Brucella spp.
DAALKRFQARHGLPADGVM

SEQ ID NO: 17701 - protein, 19 aa, Brucella spp.
FQARHGLPADGVMGQFTYA

SEQ ID NO: 17702 - protein, 23 aa, Brucella spp.
LPADGVMGQFTYAAMNVDVNTRL

SEQ ID NO: 17703 - protein, 23 aa, Brucella spp.
SKIHEVILNPYWTAPKSIIQKDI

SEQ ID NO: 17704 - protein, 25 aa, Brucella spp.
RDLDVWLLKNTPGWDRQNIEATIKS

SEQ ID NO: 17705 - protein, 30 aa, Brucella spp.
NTPIQLADPVPLHFVYISAWSTGDGVVQFR

SEQ ID NO: 17706 - protein, 18 aa, Brucella spp.
GTFLPVPLQNAYLGFYGL

SEQ ID NO: 17707 - protein, 24 aa, Brucella spp.
LTVNDLILSFFLTYGSGVTEPVEA

SEQ ID NO: 17708 - protein, 20 aa, Brucella spp.
AARLGIPAIAPFPREKPEVK

SEQ ID NO: 17709 - protein, 17 aa, Brucella spp.
IPAIAPFPREKPEVKTD

SEQ ID NO: 17710 - protein, 18 aa, Brucella spp.
KPGLPYLDIIHRLKDEFR

SEQ ID NO: 17711 - protein, 20 aa, Brucella spp.
FRLPTFAYQVSGEYAMIKAA

SEQ ID NO: 17712 - protein, 20 aa, Brucella spp.
EYAMIKAAGINGWIDEEKVM

SEQ ID NO: 17713 - protein, 19 aa, Brucella spp.
EKVMMESLLAFKRAGCDGI

SEQ ID NO: 17714 - protein, 18 aa, Brucella spp.
RACISVRILAGEFEMTRN

SEQ ID NO: 17715 - protein, 17 aa, Brucella spp.
DGLSMVYSFFSPHMQER

SEQ ID NO: 17716 - protein, 17 aa, Brucella spp.
LSMVYSFFSPHMQERSL

SEQ ID NO: 17717 - protein, 28 aa, Brucella spp.
ERARAAGLPHVYLGYWVEGSRKMQYKIR

SEQ ID NO: 17718 - protein, 22 aa, Brucella spp.
LEERYLAYALSTIMHRALPDVR

SEQ ID NO: 17719 - protein, 20 aa, Brucella spp.
VRLAQDFAVRYPLVDGQGNF

SEQ ID NO: 17720 - protein, 17 aa, Brucella spp.
FAVRYPLVDGQGNFGNI

SEQ ID NO: 17721 - protein, 23 aa, Brucella spp.
EDEEPIVLPGAFPNLLANGSAGI

SEQ ID NO: 17722 - protein, 18 aa, Brucella spp.
LLLAKKLPLLDDIRDESA

SEQ ID NO: 17723 - protein, 17 aa, Brucella spp.
LMESLFKLTELESRVSL

SEQ ID NO: 17724 - protein, 19 aa, Brucella spp.
PNVLSLGAVLREWLEHRKE

SEQ ID NO: 17725 - protein, 26 aa, Brucella spp.
EIEKRLEILGGFLIAYLNLDEVIRII

SEQ ID NO: 17726 - protein, 22 aa, Brucella spp.
SILNMRLRSLRKLEEFEIRKEF

SEQ ID NO: 17727 - protein, 18 aa, Brucella spp.
DLEGLLASGTRQWKKIST

SEQ ID NO: 17728 - protein, 20 aa, Brucella spp.
KGHLADFSTLSFKEGDKLKL

SEQ ID NO: 17729 - protein, 19 aa, Brucella spp.
EGDKLKLAFHAETTDKLLF

SEQ ID NO: 17730 - protein, 17 aa, Brucella spp.
TDKLLFFTTGGKFFTIG

SEQ ID NO: 17731 - protein, 22 aa, Brucella spp.
GRGHGEPIRILVDMENDQDILT

SEQ ID NO: 17732 - protein, 19 aa, Brucella spp.
KMLVFPLSDIPEMTRGKGV

SEQ ID NO: 17733 - protein, 17 aa, Brucella spp.
SDIPEMTRGKGVRLQKY

SEQ ID NO: 17734 - protein, 19 aa, Brucella spp.
KDGGVCDVRTFAIADGLSW

SEQ ID NO: 17735 - protein, 20 aa, Brucella spp.
DVRTFAIADGLSWQDSADRT

SEQ ID NO: 17736 - protein, 17 aa, Brucella spp.
IADGLSWQDSADRTFNR

SEQ ID NO: 17737 - protein, 21 aa, Brucella spp.
RSKEELVEWIGARASAGRLVP

SEQ ID NO: 17738 - protein, 23 aa, Brucella spp.
IRQPLLERLRFLSISAANLDEFF

SEQ ID NO: 17739 - protein, 17 aa, Brucella spp.
FLSISAANLDEFFMVRI

SEQ ID NO: 17740 - protein, 18 aa, Brucella spp.
ANLDEFFMVRIAGLAGQV

SEQ ID NO: 17741 - protein, 20 aa, Brucella spp.
LETIFPVLTPLSIDPAHPFP

SEQ ID NO: 17742 - protein, 37 aa, Brucella spp.
VLTPLSIDPAHPFPFIPNLGFSIALQLARRADNHPMT

SEQ ID NO: 17743 - protein, 17 aa, Brucella spp.
DNHPMTALLRIPVALKR

SEQ ID NO: 17744 - protein, 24 aa, Brucella spp.
TALLRIPVALKRFIQLPTDQNNIY

SEQ ID NO: 17745 - protein, 26 aa, Brucella spp.
ITIEDAVSLFIGRLFPGYEVRGAGTF

SEQ ID NO: 17746 - protein, 24 aa, Brucella spp.
LFPGYEVRGAGTFRIIRDSDIEVE

SEQ ID NO: 17747 - protein, 17 aa, Brucella spp.
EDLVRLFETALKRRRRG

SEQ ID NO: 17748 - protein, 17 aa, Brucella spp.
RRRGQVIRIEFDGEIPE

SEQ ID NO: 17749 - protein, 26 aa, Brucella spp.
FDGEIPEALRIFVAMELGVSENRISV

SEQ ID NO: 17750 - protein, 20 aa, Brucella spp.
IREHGGDCLAAIREKDIVVH

SEQ ID NO: 17751 - protein, 21 aa, Brucella spp.
PYESFDVVVQFLRQAAADPDV

SEQ ID NO: 17752 - protein, 24 aa, Brucella spp.
DLERAGVQVVFGFIELKTHAKMSL

SEQ ID NO: 17753 - protein, 24 aa, Brucella spp.
EIARDVAHIFNFITGYAQPAEEMK

SEQ ID NO: 17754 - protein, 23 aa, Brucella spp.
PAEEMKIAISPFTLRARILKHIE

SEQ ID NO: 17755 - protein, 22 aa, Brucella spp.
RFLEHSRIFCFGNGHDLPSGKA

SEQ ID NO: 17756 - protein, 19 aa, Brucella spp.
ITNMHKWYGEFHVLRDINL

SEQ ID NO: 17757 - protein, 22 aa, Brucella spp.
KWYGEFHVLRDINLKVMRGERI

SEQ ID NO: 17758 - protein, 17 aa, Brucella spp.
EVGMVFQHFNLFPHLTI

SEQ ID NO: 17759 - protein, 21 aa, Brucella spp.
VFQHFNLFPHLTILENCTLAP

SEQ ID NO: 17760 - protein, 25 aa, Brucella spp.
LTILENCTLAPIWVRKMPKKQAEEI

SEQ ID NO: 17761 - protein, 23 aa, Brucella spp.
KKQAEEIAMHYLERVKIPEQANK

SEQ ID NO: 17762 - protein, 24 aa, Brucella spp.
QQQRVAIARALCMNPKVMLFDEPT

SEQ ID NO: 17763 - protein, 20 aa, Brucella spp.
ANIASGFGFLYGRAGFDISQ

SEQ ID NO: 17764 - protein, 27 aa, Brucella spp.
EVFRNIPPLLVIFFWYFGVLSVLPPVR

SEQ ID NO: 17765 - protein, 21 aa, Brucella spp.
GEGAWAVPVALLIGILASFAV

SEQ ID NO: 17766 - protein, 26 aa, Brucella spp.
GAQIKPEFLALFLALSFYTASFIAET

SEQ ID NO: 17767 - protein, 22 aa, Brucella spp.
AVEVVAIWMVIYLGISLIVSGL

SEQ ID NO: 17768 - protein, 19 aa, Brucella spp.
RDTSLGLDFAGINYYDGQG

SEQ ID NO: 17769 - protein, 18 aa, Brucella spp.
IISKEPFGLTVRQGDARW

SEQ ID NO: 17770 - protein, 23 aa, Brucella spp.
GDARWADVVRWTHNALLNAEEYG

SEQ ID NO: 17771 - protein, 21 aa, Brucella spp.
SGSPLKIARGLNAQWNKGGLQ

SEQ ID NO: 17772 - protein, 21 aa, Brucella spp.
NTWATPLYFRALDFGVDISIH

SEQ ID NO: 17773 - protein, 25 aa, Brucella spp.
LYFRALDFGVDISIHAATKYPSGHS

SEQ ID NO: 17774 - protein, 19 aa, Brucella spp.
QLLETHGTMGLCAGPDDTY

SEQ ID NO: 17775 - protein, 18 aa, Brucella spp.
HHRKSALEIARWLENHPM

SEQ ID NO: 17776 - protein, 20 aa, Brucella spp.
RDFSGSSGIFSFVLAKGEHA

SEQ ID NO: 17777 - protein, 26 aa, Brucella spp.
LNALEIFGLGYSWGGYQSLALEVKLG

SEQ ID NO: 17778 - protein, 22 aa, Brucella spp.
ADVEFDIVLELYRTGRDAPHLY

SEQ ID NO: 17779 - protein, 18 aa, Brucella spp.
VNDFSSKIGRIFSHAVKG

SEQ ID NO: 17780 - protein, 19 aa, Brucella spp.
FSSKIGRIFSHAVKGIIVV

SEQ ID NO: 17781 - protein, 21 aa, Brucella spp.
FSHAVKGIIVVTSRLQSGAEK

SEQ ID NO: 17782 - protein, 19 aa, Brucella spp.
DRRGACIEHGFVRSQIFRS

SEQ ID NO: 17783 - protein, 17 aa, Brucella spp.
ACIEHGFVRSQIFRSDD

SEQ ID NO: 17784 - protein, 23 aa, Brucella spp.
PIKSLKFSAYYDGKYFGTIDELL

SEQ ID NO: 17785 - protein, 25 aa, Brucella spp.
SVPFRSLDQIKAFAARALEVANYSS

SEQ ID NO: 17786 - protein, 24 aa, Brucella spp.
AKICQSLSIDLQFTDQAVFDVDGV

SEQ ID NO: 17787 - protein, 19 aa, Brucella spp.
DVDGVLILGSANFERKTIQ

SEQ ID NO: 17788 - protein, 21 aa, Brucella spp.
LRSETIIANDLFITREEGDSF

SEQ ID NO: 17789 - protein, 27 aa, Brucella spp.
STPILALGAILALGAFSLWSTAQHKSP

SEQ ID NO: 17790 - protein, 18 aa, Brucella spp.
LGAFSLWSTAQHKSPQAA

SEQ ID NO: 17791 - protein, 22 aa, Brucella spp.
SPQAALSALFQRPAPKPAPAAT

SEQ ID NO: 17792 - protein, 18 aa, Brucella spp.
REMRSYGKTGRWHRVVVP

SEQ ID NO: 17793 - protein, 21 aa, Brucella spp.
RSYGKTGRWHRVVVPSTNIIG

SEQ ID NO: 17794 - protein, 24 aa, Brucella spp.
HRVVVPSTNIIGWVHEDQLIGGHN

SEQ ID NO: 17795 - protein, 24 aa, Brucella spp.
QAPGFPAEIVAVFSDKAEAGGLAK

SEQ ID NO: 17796 - protein, 26 aa, Brucella spp.
LKPDIICLAGYMRLLSGRFIAPYEGR

SEQ ID NO: 17797 - protein, 22 aa, Brucella spp.
LNIHPSLLPLFPGLHTHQRALD

SEQ ID NO: 17798 - protein, 19 aa, Brucella spp.
EHRLYPLALQKFAAGEKAS

SEQ ID NO: 17799 - protein, 21 aa, Brucella spp.
FADVVKHVILTRIVEYLKRKE

SEQ ID NO: 17800 - protein, 23 aa, Brucella spp.
RVTELDGWLALGAHLPPKEKRGL

SEQ ID NO: 17801 - protein, 22 aa, Brucella spp.
HKRFGGGTYALWYPVKDRRETE

SEQ ID NO: 17802 - protein, 20 aa, Brucella spp.
RETGIPKIMQIELAIRAPSP

SEQ ID NO: 17803 - protein, 18 aa, Brucella spp.
SEMQILLPCLTRLLEEEK

SEQ ID NO: 17804 - protein, 18 aa, Brucella spp.
YMVEEGQGFAALGRNVEF

SEQ ID NO: 17805 - protein, 21 aa, Brucella spp.
EEGQGFAALGRNVEFCVDGFD

SEQ ID NO: 17806 - protein, 17 aa, Brucella spp.
NVEFCVDGFDRWYVYDG

SEQ ID NO: 17807 - protein, 17 aa, Brucella spp.
LIKRLRPRFNVLMRDDK

SEQ ID NO: 17808 - protein, 21 aa, Brucella spp.
DDKSFPYILLTGGHRAPGIFK

SEQ ID NO: 17809 - protein, 19 aa, Brucella spp.
TRTRPCLLYQIKRCSAPCT

SEQ ID NO: 17810 - protein, 25 aa, Brucella spp.
EGGMTCIQVFFFRTGQNWGNRAYFP

SEQ ID NO: 17811 - protein, 21 aa, Brucella spp.
GPAEVLGAFLSQFYDDKPCPK

SEQ ID NO: 17812 - protein, 17 aa, Brucella spp.
LLQGLAETFGLPRAPRR

SEQ ID NO: 17813 - protein, 29 aa, Brucella spp.
GEVKNPDAFPAWPDVILIDGGQGQVGAVR

SEQ ID NO: 17814 - protein, 18 aa, Brucella spp.
RFFMEGKQPFTLPPRDPV

SEQ ID NO: 17815 - protein, 17 aa, Brucella spp.
MEGKQPFTLPPRDPVLY

SEQ ID NO: 17816 - protein, 19 aa, Brucella spp.
GKQPFTLPPRDPVLYFIQR

SEQ ID NO: 17817 - protein, 23 aa, Brucella spp.
FTLPPRDPVLYFIQRLRDEAHRF

SEQ ID NO: 17818 - protein, 18 aa, Brucella spp.
FARWTALGLFAIASITDF

SEQ ID NO: 17819 - protein, 19 aa, Brucella spp.
ELKVSVPVSRLAKWKTTAQ

SEQ ID NO: 17820 - protein, 20 aa, Brucella spp.
PYVTQIGIGLLWISAILTLY

SEQ ID NO: 17821 - protein, 23 aa, Brucella spp.
KNRREIGAIVTFTGLCRDEDGQL

SEQ ID NO: 17822 - protein, 27 aa, Brucella spp.
QALERWPLNGLTIIHRYGLIKPGENIV

SEQ ID NO: 17823 - protein, 24 aa, Brucella spp.
IALPPEASLIVQLVDMSVADTPSR

SEQ ID NO: 17824 - protein, 26 aa, Brucella spp.
IESVHGSPIPFAISFDTNAIEQGHSY

SEQ ID NO: 17825 - protein, 17 aa, Brucella spp.
QGHSYALQARISAGDTL

SEQ ID NO: 17826 - protein, 25 aa, Brucella spp.
ALQARISAGDTLWFVNDERYVIDPE

SEQ ID NO: 17827 - protein, 24 aa, Brucella spp.
TRSYKIEMGKLMLLDESDKEIARL

SEQ ID NO: 17828 - protein, 19 aa, Brucella spp.
AGLRVVASKRVWMSRREAE

SEQ ID NO: 17829 - protein, 28 aa, Brucella spp.
SRREAEGFYAVHKDRPFFGELVEFMSSG

SEQ ID NO: 17830 - protein, 17 aa, Brucella spp.
GTIRKAFALSIGENSVH

SEQ ID NO: 17831 - protein, 27 aa, Brucella spp.
LLIPSAIPLVMPFALIIAITQTLSTMN

SEQ ID NO: 17832 - protein, 17 aa, Brucella spp.
FAKDRPLTYLLNPDSND

SEQ ID NO: 17833 - protein, 23 aa, Brucella spp.
FTQWIYPLIFAMIALAIAGDSRS

SEQ ID NO: 17834 - protein, 17 aa, Brucella spp.
YILVMYLVPLVVFLVTG

SEQ ID NO: 17835 - protein, 18 aa, Brucella spp.
VFLVTGFILLTGRRLGLP

SEQ ID NO: 17836 - protein, 21 aa, Brucella spp.
RYVQITLYFLLGIFALALLLD

SEQ ID NO: 17837 - protein, 25 aa, Brucella spp.
QFLLPACFGALLFGLATIFILNPLA

SEQ ID NO: 17838 - protein, 21 aa, Brucella spp.
LRHKIEVARSFGYSANAFDMQ

SEQ ID NO: 17839 - protein, 27 aa, Brucella spp.
LARGTALACVLALPFVSVAILSSPAQA

SEQ ID NO: 17840 - protein, 19 aa, Brucella spp.
KPVLWQIKARKIIWNSATK

SEQ ID NO: 17841 - protein, 32 aa, Brucella spp.
VRFERGRFELFGMPLAYLPAFEMADPTVKRKS

SEQ ID NO: 17842 - protein, 43 aa, Brucella spp.
TVKRKSGFLFPGFAYKDDLGFGIKNSYFWALAPNYDLTLSTTA

SEQ ID NO: 17843 - protein, 23 aa, Brucella spp.
NFDINSRWHFGWDVLAQTDHNFS

SEQ ID NO: 17844 - protein, 18 aa, Brucella spp.
MYSKQPWVFPSLDYSYTM

SEQ ID NO: 17845 - protein, 20 aa, Brucella spp.
GELNFTANLQALYRKNADYT

SEQ ID NO: 17846 - protein, 21 aa, Brucella spp.
SEAEWKRTFITPSGLVITPLL

SEQ ID NO: 17847 - protein, 18 aa, Brucella spp.
LRAMATAGLELRWPILFS

SEQ ID NO: 17848 - protein, 26 aa, Brucella spp.
MATAGLELRWPILFSTTSSTHILEPV

SEQ ID NO: 17849 - protein, 20 aa, Brucella spp.
NEDAQSFVFDASNLFSRNKF

SEQ ID NO: 17850 - protein, 23 aa, Brucella spp.
ASHSVGFTISLRTLGDFGNGSQT

SEQ ID NO: 17851 - protein, 21 aa, Brucella spp.
SDIKHRMAFLKLQRKSGNLNQ

SEQ ID NO: 17852 - protein, 32 aa, Brucella spp.
EHFKKYIMVQMGWGRLVSARFRATGMVSEQEA

SEQ ID NO: 17853 - protein, 23 aa, Brucella spp.
VATEYHLQQVIFVVPASKRSPAL

SEQ ID NO: 17854 - protein, 17 aa, Brucella spp.
RQEANALRARFQNCDST

SEQ ID NO: 17855 - protein, 21 aa, Brucella spp.
IEPQLPGEWSKDVKAAGVNRT

SEQ ID NO: 17856 - protein, 17 aa, Brucella spp.
VALVLLILLGQFRGILS

SEQ ID NO: 17857 - protein, 22 aa, Brucella spp.
NPLFNVVLGRLFLGERLTKTQY

SEQ ID NO: 17858 - protein, 21 aa, Brucella spp.
SLALPISFGLYGFFRKSLPMP

SEQ ID NO: 17859 - protein, 17 aa, Brucella spp.
KSLPMPPLQGFTLEVLI

SEQ ID NO: 17860 - protein, 19 aa, Brucella spp.
TPTMLFFFAIFIFHEPFST

SEQ ID NO: 17861 - protein, 22 aa, Brucella spp.
RRQTARAKFVAFGMTKRAGVSV

SEQ ID NO: 17862 - protein, 19 aa, Brucella spp.
VAKSWDYHVRLALGCTNEE

SEQ ID NO: 17863 - protein, 25 aa, Brucella spp.
LACAKAAYSAGARWVVLCDTNGGTQ

SEQ ID NO: 17864 - protein, 34 aa, Brucella spp.
LVSLIPTLVLKPYWAERFELGIKPASLKSITRIS

SEQ ID NO: 17865 - protein, 17 aa, Brucella spp.
LDTLIALVKEREAEGYA

SEQ ID NO: 17866 - protein, 19 aa, Brucella spp.
ADASFELLARGMLNPQPEF

SEQ ID NO: 17867 - protein, 26 aa, Brucella spp.
NPQPEFFKVESFRCLVERRFDANGML

SEQ ID NO: 17868 - protein, 18 aa, Brucella spp.
FRCLVERRFDANGMLKTV

SEQ ID NO: 17869 - protein, 17 aa, Brucella spp.
IEDLELVDFKVRILNGG

SEQ ID NO: 17870 - protein, 22 aa, Brucella spp.
DLELVDFKVRILNGGTAAITRV

SEQ ID NO: 17871 - protein, 17 aa, Brucella spp.
DATGARWRTVGVSDNII

SEQ ID NO: 17872 - protein, 21 aa, Brucella spp.
LETLFGALIAEDFPPRYNIAP

SEQ ID NO: 17873 - protein, 27 aa, Brucella spp.
NRPDRIAMLVRWGFVPAWVKDPNDWPL

SEQ ID NO: 17874 - protein, 25 aa, Brucella spp.
VKDPNDWPLMFNIRSETAAEKNSFK

SEQ ID NO: 17875 - protein, 20 aa, Brucella spp.
RALVPASGFYEWRREGRNKS

SEQ ID NO: 17876 - protein, 17 aa, Brucella spp.
KGWLAFPGGGVEAGETP

SEQ ID NO: 17877 - protein, 20 aa, Brucella spp.
SLCHVITIDLAREGNAYEKS

SEQ ID NO: 17878 - protein, 19 aa, Brucella spp.
KSYYLSVYRTLEISGTEQP

SEQ ID NO: 17879 - protein, 18 aa, Brucella spp.
DDAAAIRWLTVEEMETAN

SEQ ID NO: 17880 - protein, 17 aa, Brucella spp.
GDIERLRPLLGVQDKAT

SEQ ID NO: 17881 - protein, 26 aa, Brucella spp.
QQNEVYVWPYFYAMPLDKLTPPQIVE

SEQ ID NO: 17882 - protein, 17 aa, Brucella spp.
KAGGYIFYSIGIGPDGS

SEQ ID NO: 17883 - protein, 23 aa, Brucella spp.
LTPQGKILFDFLVSRIEGGLRFD

SEQ ID NO: 17884 - protein, 21 aa, Brucella spp.
LVSRIEGGLRFDLPADVAGDF

SEQ ID NO: 17885 - protein, 26 aa, Brucella spp.
GLRFDLPADVAGDFVKRITLYRLRAK

SEQ ID NO: 17886 - protein, 18 aa, Brucella spp.
VQVPESLVSVCWQGDSPA

SEQ ID NO: 17887 - protein, 17 aa, Brucella spp.
SLVSVCWQGDSPASDND

SEQ ID NO: 17888 - protein, 24 aa, Brucella spp.
RDSRFPAQLNVLRLYHQASANAGL

SEQ ID NO: 17889 - protein, 19 aa, Brucella spp.
FAYGDVFPHDVNFDQTGGV

SEQ ID NO: 17890 - protein, 19 aa, Brucella spp.
HDVNFDQTGGVSFPKGCFI

SEQ ID NO: 17891 - protein, 21 aa, Brucella spp.
PGASIEWQMLALLHDAPEYVI

SEQ ID NO: 17892 - protein, 24 aa, Brucella spp.
ESAIHLRFSLPVSPPAKLKTLIKR

SEQ ID NO: 17893 - protein, 21 aa, Brucella spp.
RADQVAAFFEATRLAGFTEAE

SEQ ID NO: 17894 - protein, 18 aa, Brucella spp.
AFFEATRLAGFTEAEGVK

SEQ ID NO: 17895 - protein, 19 aa, Brucella spp.
EAEGVKYFGRPRGLNPVGL

SEQ ID NO: 17896 - protein, 20 aa, Brucella spp.
SHVRALIDFVQGWPRKAPLL

SEQ ID NO: 17897 - protein, 27 aa, Brucella spp.
DFVQGWPRKAPLLIHCYAGISRSTAAA

SEQ ID NO: 17898 - protein, 18 aa, Brucella spp.
HRLAERLRRFSPSATPNI

SEQ ID NO: 17899 - protein, 18 aa, Brucella spp.
IEPLSFAAARLIETPVAL

SEQ ID NO: 17900 - protein, 29 aa, Brucella spp.
GELLLRFEVMMLEELGFGLDLKECAATGR

SEQ ID NO: 17901 - protein, 17 aa, Brucella spp.
LGFGLDLKECAATGRKD

SEQ ID NO: 17902 - protein, 18 aa, Brucella spp.
LLSLPSFVNDTALRASCY

SEQ ID NO: 17903 - protein, 22 aa, Brucella spp.
DLDRAFTMTGYFLMRHVWEPRA

SEQ ID NO: 17904 - protein, 18 aa, Brucella spp.
PAQIVLVDTPGIFRPKRR

SEQ ID NO: 17905 - protein, 18 aa, Brucella spp.
ADIILVIIDAQGGFNENA

SEQ ID NO: 17906 - protein, 19 aa, Brucella spp.
VDPPVLLSLAQKANGLVPF

SEQ ID NO: 17907 - protein, 23 aa, Brucella spp.
NGLVPFDRTFMISALNGSGCKDL

SEQ ID NO: 17908 - protein, 21 aa, Brucella spp.
GSGCKDLAKYLAESVPNGPWY

SEQ ID NO: 17909 - protein, 20 aa, Brucella spp.
LEQTVHQFLFVKVRENWGND

SEQ ID NO: 17910 - protein, 24 aa, Brucella spp.
NYERLEFLGDRVLGLTVAEMLFEA

SEQ ID NO: 17911 - protein, 17 aa, Brucella spp.
LEAARSFIQRYWKKRSL

SEQ ID NO: 17912 - protein, 19 aa, Brucella spp.
HDPLFLVEVTVKGFAPEKG

SEQ ID NO: 17913 - protein, 18 aa, Brucella spp.
IAEGVFWRDMGVVNTPSG

SEQ ID NO: 17914 - protein, 24 aa, Brucella spp.
TPFFGFHLIIAIVLAYFLAGNVAA

SEQ ID NO: 17915 - protein, 21 aa, Brucella spp.
NPLTLPFIWGSTFELGRFIMS

SEQ ID NO: 17916 - protein, 18 aa, Brucella spp.
EVWTPLLKPMLFGSTILG

SEQ ID NO: 17917 - protein, 17 aa, Brucella spp.
KPMPYSLTFGMGCTLIG

SEQ ID NO: 17918 - protein, 17 aa, Brucella spp.
MPYSLTFGMGCTLIGLV

SEQ ID NO: 17919 - protein, 17 aa, Brucella spp.
FGMGCTLIGLVFLATAH

SEQ ID NO: 17920 - protein, 17 aa, Brucella spp.
SWFSVAALIGMFVLWYV

SEQ ID NO: 17921 - protein, 19 aa, Brucella spp.
SVAALIGMFVLWYVGNWYN

SEQ ID NO: 17922 - protein, 22 aa, Brucella spp.
ANLEMTAVLTIIIGLILASAFP

SEQ ID NO: 17923 - protein, 18 aa, Brucella spp.
LLPGRVGMLSGLFFGFAF

SEQ ID NO: 17924 - protein, 19 aa, Brucella spp.
RVGMLSGLFFGFAFGMAGI

SEQ ID NO: 17925 - protein, 24 aa, Brucella spp.
YRICSYLPFLGLLTIFLPKLERRR

SEQ ID NO: 17926 - protein, 18 aa, Brucella spp.
AILEGHFILTSGLRSPVF

SEQ ID NO: 17927 - protein, 18 aa, Brucella spp.
FILTSGLRSPVFLQKARV

SEQ ID NO: 17928 - protein, 24 aa, Brucella spp.
ETSRHLGVPSVWVERENGVFRLRR

SEQ ID NO: 17929 - protein, 25 aa, Brucella spp.
DPYFSHPLEVAAILTDMHLDEATIA

SEQ ID NO: 17930 - protein, 22 aa, Brucella spp.
HLDEATIAIALLHDTIEDTTAT

SEQ ID NO: 17931 - protein, 20 aa, Brucella spp.
LEELAFRYINPDAWRAVTDR

SEQ ID NO: 17932 - protein, 22 aa, Brucella spp.
SFEQLSDIFGFRVMVDTVQDCY

SEQ ID NO: 17933 - protein, 18 aa, Brucella spp.
EIAEFGVAAHSIYKDRGS

SEQ ID NO: 17934 - protein, 21 aa, Brucella spp.
ISTETNAYAWLRQTIEQLSEG

SEQ ID NO: 17935 - protein, 18 aa, Brucella spp.
HTKLELFQDQVFCFTPKG

SEQ ID NO: 17936 - protein, 17 aa, Brucella spp.
FTPKGRLIALPRGATPI

SEQ ID NO: 17937 - protein, 21 aa, Brucella spp.
PRGATPIDFAYAVHTDIGDSC

SEQ ID NO: 17938 - protein, 18 aa, Brucella spp.
PDLPVRFAPEGAVPGDRI

SEQ ID NO: 17939 - protein, 18 aa, Brucella spp.
SERFPARISVSAINSPGS

SEQ ID NO: 17940 - protein, 19 aa, Brucella spp.
PDFTEMIIDVEVWDLKHLN

SEQ ID NO: 17941 - protein, 24 aa, Brucella spp.
KVENRFELVLLAGHRARQISQGAP

SEQ ID NO: 17942 - protein, 18 aa, Brucella spp.
QISQGAPITVDRDNDKNP

SEQ ID NO: 17943 - protein, 22 aa, Brucella spp.
SICPRLHAFLQEWRQKEPAWHN

SEQ ID NO: 17944 - protein, 17 aa, Brucella spp.
SDEDVRLLIVGLAPGLR

SEQ ID NO: 17945 - protein, 18 aa, Brucella spp.
VRLLIVGLAPGLRGANRT

SEQ ID NO: 17946 - protein, 21 aa, Brucella spp.
LYSTLCEFGFATGKFEARPDD

SEQ ID NO: 17947 - protein, 23 aa, Brucella spp.
GKATDIGPLRIFSSYHCSRYNTN

SEQ ID NO: 17948 - protein, 19 aa, Brucella spp.
ENPSSATIIATFGSTRPQT

SEQ ID NO: 17949 - protein, 19 aa, Brucella spp.
QKILKEFSAILTREDHQRR

SEQ ID NO: 17950 - protein, 22 aa, Brucella spp.
QANPVYQFLKIRYLRRAERYNE

SEQ ID NO: 17951 - protein, 23 aa, Brucella spp.
MAAEAEFHAGWYALRALNQPKLA

SEQ ID NO: 17952 - protein, 25 aa, Brucella spp.
SARPISASRAYYWLGRAAEAGSGGD

SEQ ID NO: 17953 - protein, 23 aa, Brucella spp.
YYRRSAHFGTTFYGQLAAAKLNE

SEQ ID NO: 17954 - protein, 18 aa, Brucella spp.
SVGELALLAVMAERNDNH

SEQ ID NO: 17955 - protein, 24 aa, Brucella spp.
QLDRFNGSYVLTFAGYNAGPRRAS

SEQ ID NO: 17956 - protein, 22 aa, Brucella spp.
EIDEILKGARFSGFDQEMLDSI

SEQ ID NO: 17957 - protein, 20 aa, Brucella spp.
HKMGDIFNLPEFIRQKERVG

SEQ ID NO: 17958 - protein, 20 aa, Brucella spp.
GCRLGEAIGLTWNDIQEQRV

SEQ ID NO: 17959 - protein, 22 aa, Brucella spp.
RLKGPFSMLNQVRFRQIWNEAK

SEQ ID NO: 17960 - protein, 17 aa, Brucella spp.
MLNQVRFRQIWNEAKAE

SEQ ID NO: 17961 - protein, 19 aa, Brucella spp.
TLGNMKWNDFRKAQCGDDA

SEQ ID NO: 17962 - protein, 20 aa, Brucella spp.
STDNGMKWNDFRKAECGPGA

SEQ ID NO: 17963 - protein, 22 aa, Brucella spp.
APKGVKFPTAVSAKYSKESAGK

SEQ ID NO: 17964 - protein, 20 aa, Brucella spp.
ARMHTCLDQYHALKDANALG

SEQ ID NO: 17965 - protein, 35 aa, Brucella spp.
DQYHALKDANALGGLKWVQKGGGYYSLCNARLKGN

SEQ ID NO: 17966 - protein, 18 aa, Brucella spp.
FADEAIVGTWKRPNGTLI

SEQ ID NO: 17967 - protein, 24 aa, Brucella spp.
IVGTWKRPNGTLISYAACGANKFC

SEQ ID NO: 17968 - protein, 26 aa, Brucella spp.
TVRESSTPIPIHFAFKEGAHVEASVA

SEQ ID NO: 17969 - protein, 18 aa, Brucella spp.
GAHVEASVASAFTHPLRD

SEQ ID NO: 17970 - protein, 18 aa, Brucella spp.
ASVASAFTHPLRDLFDVP

SEQ ID NO: 17971 - protein, 19 aa, Brucella spp.
GEPMPLAPFTAQRIDYSLH

SEQ ID NO: 17972 - protein, 17 aa, Brucella spp.
FQNFVLFTNYQFYMDEF

SEQ ID NO: 17973 - protein, 24 aa, Brucella spp.
HIAVLRPHAWLMLGHCAGLRNSQQ

SEQ ID NO: 17974 - protein, 24 aa, Brucella spp.
VLDDDLPVWVPLPALAEIQVALEE

SEQ ID NO: 17975 - protein, 22 aa, Brucella spp.
ANGFRFRVPYGTLLCVSDKPLH

SEQ ID NO: 17976 - protein, 21 aa, Brucella spp.
GELKLPGMATEFYKRQVAQHL

SEQ ID NO: 17977 - protein, 23 aa, Brucella spp.
HLRIHLAVLMGLLALPLLFTKLR

SEQ ID NO: 17978 - protein, 24 aa, Brucella spp.
KLRREGAMILLLAVFAIAVTPHVF

SEQ ID NO: 17979 - protein, 23 aa, Brucella spp.
VAALHLHWPWPFQQSEQIEALSE

SEQ ID NO: 17980 - protein, 17 aa, Brucella spp.
RESMEFDVVIVGAGPAG

SEQ ID NO: 17981 - protein, 24 aa, Brucella spp.
EELGVEIYPGFAATEVLYNDEGAV

SEQ ID NO: 17982 - protein, 19 aa, Brucella spp.
YTRGMALLGKYVLIGEGAR

SEQ ID NO: 17983 - protein, 25 aa, Brucella spp.
REPAKFGIGLKELWQVDPSKHKPGL

SEQ ID NO: 17984 - protein, 17 aa, Brucella spp.
GLVQHSFGWPLDMKTGG

SEQ ID NO: 17985 - protein, 26 aa, Brucella spp.
VQHSFGWPLDMKTGGGSFLYHLEDNM

SEQ ID NO: 17986 - protein, 18 aa, Brucella spp.
DNMVAVGFVLHLNYKNPY

SEQ ID NO: 17987 - protein, 25 aa, Brucella spp.
RVRNVKPLWSKFGTAIGIALGGLDM

SEQ ID NO: 17988 - protein, 18 aa, Brucella spp.
FGTAIGIALGGLDMWTNQ

SEQ ID NO: 17989 - protein, 26 aa, Brucella spp.
GGLDMWTNQLFGFSFFGTMKHGKTDA

SEQ ID NO: 17990 - protein, 23 aa, Brucella spp.
STRYCPAGVYEWVDADGNAAADP

SEQ ID NO: 17991 - protein, 20 aa, Brucella spp.
DMEGLLRFYAEAGVDVPLCE

SEQ ID NO: 17992 - protein, 17 aa, Brucella spp.
FYAEAGVDVPLCETPID

SEQ ID NO: 17993 - protein, 24 aa, Brucella spp.
LKREEVYIANTIPWRPPGNRAPTP

SEQ ID NO: 17994 - protein, 20 aa, Brucella spp.
IELAAPKVLVALGGPAGKAL

SEQ ID NO: 17995 - protein, 25 aa, Brucella spp.
PTGMEIPVMPTLHPAYLLRTPAQKR

SEQ ID NO: 17996 - protein, 22 aa, Brucella spp.
PAQKRFAWRDFLAVKLKLAELR

SEQ ID NO: 17997 - protein, 26 aa, Brucella spp.
FTIGCIFIPHLVRRVGHVRVFSALLT

SEQ ID NO: 17998 - protein, 18 aa, Brucella spp.
LVVNPAAWMIFRGITGFS

SEQ ID NO: 17999 - protein, 17 aa, Brucella spp.
AWMIFRGITGFSLAGSY

SEQ ID NO: 18000 - protein, 19 aa, Brucella spp.
RGMIFSIYMIITMVGLLLG

SEQ ID NO: 18001 - protein, 24 aa, Brucella spp.
AIAYCIYGLHAWWRIYRLERPAIS

SEQ ID NO: 18002 - protein, 17 aa, Brucella spp.
AIPETKLDFTLEPEKTI

SEQ ID NO: 18003 - protein, 17 aa, Brucella spp.
PETKLDFTLEPEKTIVR

SEQ ID NO: 18004 - protein, 18 aa, Brucella spp.
TKLDFTLEPEKTIVRATL

SEQ ID NO: 18005 - protein, 23 aa, Brucella spp.
SDLPKDVRFTLQIVTEVNPTANR

SEQ ID NO: 18006 - protein, 20 aa, Brucella spp.
CEAEGFRRITYFYDRPDVLS

SEQ ID NO: 18007 - protein, 18 aa, Brucella spp.
DRPDVLSVYTVRVDADRK

SEQ ID NO: 18008 - protein, 24 aa, Brucella spp.
HDPHPKPSYLFALVAGSLGVVKDH

SEQ ID NO: 18009 - protein, 19 aa, Brucella spp.
AVIAHEYFHNWTGNRITCR

SEQ ID NO: 18010 - protein, 20 aa, Brucella spp.
CLKEGLTVYRDHEFSADQRS

SEQ ID NO: 18011 - protein, 27 aa, Brucella spp.
VRMIRTIIGPELFRKGMDLYFERHDGD

SEQ ID NO: 18012 - protein, 23 aa, Brucella spp.
VSGQDFSQFALWYDQAGTPKVEA

SEQ ID NO: 18013 - protein, 27 aa, Brucella spp.
QSIRKPMHIPIAFGLIGPDGKDMQPSS

SEQ ID NO: 18014 - protein, 20 aa, Brucella spp.
RRPSETIVFHGIEARPVPSL

SEQ ID NO: 18015 - protein, 31 aa, Brucella spp.
GIEARPVPSLLRGFSAPVNLAAPLTAEDRVF

SEQ ID NO: 18016 - protein, 19 aa, Brucella spp.
PLTAEDRVFLALNDSDPVA

SEQ ID NO: 18017 - protein, 21 aa, Brucella spp.
DPKIVALAGKVAFDEMLDPAF

SEQ ID NO: 18018 - protein, 21 aa, Brucella spp.
DRATALAVLVHRFGDSGEARQ

SEQ ID NO: 18019 - protein, 20 aa, Brucella spp.
DALVMDKWFIVQATRPGETA

SEQ ID NO: 18020 - protein, 21 aa, Brucella spp.
DGAAYGFLADTLLTIDPKNPQ

SEQ ID NO: 18021 - protein, 23 aa, Brucella spp.
PQLSARLLTAMRSWRSLEEVRRE

SEQ ID NO: 18022 - protein, 18 aa, Brucella spp.
LSGHVSLLAGPAYSKFIV

SEQ ID NO: 18023 - protein, 19 aa, Brucella spp.
AYSKFIVIEPILRRLVPTL

SEQ ID NO: 18024 - protein, 26 aa, Brucella spp.
PILRRLVPTLIIIFLIILGVARVFSL

SEQ ID NO: 18025 - protein, 24 aa, Brucella spp.
ILGVARVFSLLAWRDDIELQHKAA

SEQ ID NO: 18026 - protein, 23 aa, Brucella spp.
ILGDAQPLFLFAERAGVLRVVLQ

SEQ ID NO: 18027 - protein, 26 aa, Brucella spp.
STIFAEWKRAVSLNVTLFAGTIGVMF

SEQ ID NO: 18028 - protein, 29 aa, Brucella spp.
VTLFAGTIGVMFAILYAYFSQAARAREAD

SEQ ID NO: 18029 - protein, 19 aa, Brucella spp.
GRCGLWDWDMARGRIYWSR

SEQ ID NO: 18030 - protein, 18 aa, Brucella spp.
DAVLPFGDVAAIINEEDG

SEQ ID NO: 18031 - protein, 17 aa, Brucella spp.
RHADGSWVWMRVRAEIA

SEQ ID NO: 18032 - protein, 19 aa, Brucella spp.
ASEGDLHLVGIAFDVSEQH

SEQ ID NO: 18033 - protein, 25 aa, Brucella spp.
SKFSEYAGLPVWTLKPGVPRNEVDA

SEQ ID NO: 18034 - protein, 22 aa, Brucella spp.
ELRTPLNAIIGFSEMIQAGTFG

SEQ ID NO: 18035 - protein, 17 aa, Brucella spp.
IGFSEMIQAGTFGPLGS

SEQ ID NO: 18036 - protein, 17 aa, Brucella spp.
IDLCPLINETVRIISLQ

SEQ ID NO: 18037 - protein, 18 aa, Brucella spp.
ARKTGAALFMTIQDTGVG

SEQ ID NO: 18038 - protein, 17 aa, Brucella spp.
VAMERFWHHKARLFSSD

SEQ ID NO: 18039 - protein, 23 aa, Brucella spp.
LTGELIAAISLLVFMSTVWVETD

SEQ ID NO: 18040 - protein, 17 aa, Brucella spp.
AALIRYARTDFWKYEKP

SEQ ID NO: 18041 - protein, 29 aa, Brucella spp.
AGLLCVAWTFYVLARFAYIYLFYPEMGTG

SEQ ID NO: 18042 - protein, 26 aa, Brucella spp.
TGSAEGIYLFPLFYPTLGFALLLFIR

SEQ ID NO: 18043 - protein, 35 aa, Brucella spp.
LFYPTLGFALLLFIRRPFLIAVAFMAISLVILIFG

SEQ ID NO: 18044 - protein, 19 aa, Brucella spp.
RVVLCLLALATFIAALIAI

SEQ ID NO: 18045 - protein, 29 aa, Brucella spp.
HNGYLEIAIRYGFLGLLFYGVLTVWAVRC

SEQ ID NO: 18046 - protein, 20 aa, Brucella spp.
QCYVATLVFFAVTILSNSNV

SEQ ID NO: 18047 - protein, 24 aa, Brucella spp.
GESYMALAFGFAFYCQYLLQQHNR

SEQ ID NO: 18048 - protein, 23 aa, Brucella spp.
REEELAGVVALLGRKKAADFLSA

SEQ ID NO: 18049 - protein, 25 aa, Brucella spp.
QLKREAHVLIALCDLARIFNTETTT

SEQ ID NO: 18050 - protein, 23 aa, Brucella spp.
LAEACTGAAVRFLLLDADAAGRI

SEQ ID NO: 18051 - protein, 21 aa, Brucella spp.
KDCGWIVLGMGKFGARELNYS

SEQ ID NO: 18052 - protein, 23 aa, Brucella spp.
LNYSSDIDLIVFIDETKPAIGDP

SEQ ID NO: 18053 - protein, 19 aa, Brucella spp.
LAIPVGAALHYYEGRGQNW

SEQ ID NO: 18054 - protein, 26 aa, Brucella spp.
KQILAELSPYVWRKYLDYAAIADVHS

SEQ ID NO: 18055 - protein, 17 aa, Brucella spp.
LAQEYWFLRDVEHRIQM

SEQ ID NO: 18056 - protein, 23 aa, Brucella spp.
YADPAEFSEIFLAALKVVEKQYA

SEQ ID NO: 18057 - protein, 19 aa, Brucella spp.
RLLNLLVMIMSAAPRLADI

SEQ ID NO: 18058 - protein, 17 aa, Brucella spp.
HVFDGLLDPAIFSEVPT

SEQ ID NO: 18059 - protein, 18 aa, Brucella spp.
YLEERLRAFLGSATDFEE

SEQ ID NO: 18060 - protein, 26 aa, Brucella spp.
LRIFAAEHRFLIGIRLLTGAINGVRA

SEQ ID NO: 18061 - protein, 20 aa, Brucella spp.
FSDLAELMVGRALEAVEAEL

SEQ ID NO: 18062 - protein, 20 aa, Brucella spp.
RPIHGDEAFIARIKVDIEDV

SEQ ID NO: 18063 - protein, 26 aa, Brucella spp.
LKLKPGGIIDLEFIAQFATLAGYVKK

SEQ ID NO: 18064 - protein, 20 aa, Brucella spp.
PGMRELLCRVAGLPDIERIE

SEQ ID NO: 18065 - protein, 18 aa, Brucella spp.
ELLEHYRLVRAAFDKLVG

SEQ ID NO: 18066 - protein, 18 aa, Brucella spp.
KRDGLSVVAGLRAKGMET

SEQ ID NO: 18067 - protein, 21 aa, Brucella spp.
KGMETPVLILSALGEVDDRVT

SEQ ID NO: 18068 - protein, 17 aa, Brucella spp.
KPYAFSELLARVEVLQR

SEQ ID NO: 18069 - protein, 19 aa, Brucella spp.
YAFSELLARVEVLQRRSSP

SEQ ID NO: 18070 - protein, 23 aa, Brucella spp.
LQPREFRLLEYLMRHAGQVVTRT

SEQ ID NO: 18071 - protein, 18 aa, Brucella spp.
MLLENVWDYHFDPQTNVI

SEQ ID NO: 18072 - protein, 18 aa, Brucella spp.
FDEPLLHTVRGAGYMLKA

SEQ ID NO: 18073 - protein, 33 aa, Brucella spp.
LLKPRFNAQTALLWGFPVIILLIGGGALLVAFR

SEQ ID NO: 18074 - protein, 22 aa, Brucella spp.
HEGSMLLWVFILTLFSALVAAF

SEQ ID NO: 18075 - protein, 21 aa, Brucella spp.
LAIHPPLLYLGYVGFSVCFSF

SEQ ID NO: 18076 - protein, 17 aa, Brucella spp.
FSVCFSFAVAALLEGRL

SEQ ID NO: 18077 - protein, 24 aa, Brucella spp.
GRLDAAWARWVRPWALMAWMFLTG

SEQ ID NO: 18078 - protein, 20 aa, Brucella spp.
VRPWALMAWMFLTGGIAMGS

SEQ ID NO: 18079 - protein, 24 aa, Brucella spp.
WAYYELGWGGWWFWDPVENASLMP

SEQ ID NO: 18080 - protein, 18 aa, Brucella spp.
WDPVENASLMPWLVGTAL

SEQ ID NO: 18081 - protein, 21 aa, Brucella spp.
VENASLMPWLVGTALLHSAIV

SEQ ID NO: 18082 - protein, 17 aa, Brucella spp.
RSALKIWTVLLAILTFS

SEQ ID NO: 18083 - protein, 17 aa, Brucella spp.
FAVPFGPLLAWKRGDLY

SEQ ID NO: 18084 - protein, 17 aa, Brucella spp.
PLLAWKRGDLYGVGQRL

SEQ ID NO: 18085 - protein, 24 aa, Brucella spp.
VRIWWKPLVTLIWYGALVMMLGGL

SEQ ID NO: 18086 - protein, 17 aa, Brucella spp.
FNQDIRFFRTPADLTEQ

SEQ ID NO: 18087 - protein, 18 aa, Brucella spp.
MTSGARFRLGGLVEEGSV

SEQ ID NO: 18088 - protein, 24 aa, Brucella spp.
KVVFEGIPPDLFREGQGVVAEGRF

SEQ ID NO: 18089 - protein, 19 aa, Brucella spp.
FAATLAVLLPLTRRRQAAL

SEQ ID NO: 18090 - protein, 17 aa, Brucella spp.
LAVLLPLTRRRQAALPA

SEQ ID NO: 18091 - protein, 40 aa, Brucella spp.
LAVPLVAWGIYPLFGAPDMPSMPLAPRLAAAPDRSSVTDL

SEQ ID NO: 18092 - protein, 26 aa, Brucella spp.
GDVRGWDVLAPIYLRLGRASDAVSAY

SEQ ID NO: 18093 - protein, 20 aa, Brucella spp.
DIDGWKRLVRSYMILNRRND

SEQ ID NO: 18094 - protein, 20 aa, Brucella spp.
EPYDAVVLDIGLPQMDGISV

SEQ ID NO: 18095 - protein, 21 aa, Brucella spp.
LPQMDGISVVERWRRSGRTIP

SEQ ID NO: 18096 - protein, 21 aa, Brucella spp.
SGRTIPVLMLTARDRWSDKVA

SEQ ID NO: 18097 - protein, 19 aa, Brucella spp.
GVDLIETVRGMGYRMRSGG

SEQ ID NO: 18098 - protein, 17 aa, Brucella spp.
VFALLAVSVGLLPVNAG

SEQ ID NO: 18099 - protein, 23 aa, Brucella spp.
NGRAMCVIVVLIPGRNGERPRRV

SEQ ID NO: 18100 - protein, 20 aa, Brucella spp.
RFPLGVSFGATGGPEWRNEI

SEQ ID NO: 18101 - protein, 21 aa, Brucella spp.
LDDLRMVLAFFEARRGSLHAF

SEQ ID NO: 18102 - protein, 19 aa, Brucella spp.
SLHAFRFRDPFDFSSATGK

SEQ ID NO: 18103 - protein, 23 aa, Brucella spp.
PARDVPVTSGFLFDVPARFDTDR

SEQ ID NO: 18104 - protein, 24 aa, Brucella spp.
GLLSGIRGIMPFAKGGVVSSPTYF

SEQ ID NO: 18105 - protein, 26 aa, Brucella spp.
RLDGRDWTLCLTLGALAELESVFETD

SEQ ID NO: 18106 - protein, 17 aa, Brucella spp.
TDNLSALVARFSSGRLS

SEQ ID NO: 18107 - protein, 20 aa, Brucella spp.
DAASDALIRRIFFDGEIRDW

SEQ ID NO: 18108 - protein, 17 aa, Brucella spp.
LIRRIFFDGEIRDWQIV

SEQ ID NO: 18109 - protein, 23 aa, Brucella spp.
LASDTAWLWFAKIAGAVAGSAVS

SEQ ID NO: 18110 - protein, 17 aa, Brucella spp.
LIAEAASTIPWLLYEGA

SEQ ID NO: 18111 - protein, 19 aa, Brucella spp.
AASTIPWLLYEGATEHEAH

SEQ ID NO: 18112 - protein, 17 aa, Brucella spp.
SFFERLYGHLLIAGNAY

SEQ ID NO: 18113 - protein, 19 aa, Brucella spp.
RLYGHLLIAGNAYVERVDL

SEQ ID NO: 18114 - protein, 24 aa, Brucella spp.
APGLHLKLFHPLDDHYGFPPLEAA

SEQ ID NO: 18115 - protein, 23 aa, Brucella spp.
RPLLLEGGLDWKAMGYSPQDMDF

SEQ ID NO: 18116 - protein, 24 aa, Brucella spp.
GAARDIALAFGVPPMLLGIPGDNT

SEQ ID NO: 18117 - protein, 23 aa, Brucella spp.
RAFYRLTVLPLIGRTAKAFGNWL

SEQ ID NO: 18118 - protein, 26 aa, Brucella spp.
AQLPPDGDWRVWLIMGGRGSGKTRAG

SEQ ID NO: 18119 - protein, 26 aa, Brucella spp.
TRAGAEWVSGMALGLPPFAGKPSGHI

SEQ ID NO: 18120 - protein, 19 aa, Brucella spp.
SRRRLIWDNGAVATLFSSE

SEQ ID NO: 18121 - protein, 19 aa, Brucella spp.
PQFDAAWCDELAKWKNPQE

SEQ ID NO: 18122 - protein, 17 aa, Brucella spp.
NLAEGFMQTIARRYAGT

SEQ ID NO: 18123 - protein, 19 aa, Brucella spp.
MAKPHQWARRAIALYHTHE

SEQ ID NO: 18124 - protein, 18 aa, Brucella spp.
RAEPVAALYEQGRVRHAG

SEQ ID NO: 18125 - protein, 22 aa, Brucella spp.
PDRLDALVWALGELMLGADHKP

SEQ ID NO: 18126 - protein, 25 aa, Brucella spp.
ILGLSEERYDLWLRRLKCTGSEAKA

SEQ ID NO: 18127 - protein, 21 aa, Brucella spp.
AIVHIAIVFLVPVYSDKNAWS

SEQ ID NO: 18128 - protein, 23 aa, Brucella spp.
RKLDLVIADPIGMASLRSDASRS

SEQ ID NO: 18129 - protein, 19 aa, Brucella spp.
QNIGEGAAVLRVFVPDTTW

SEQ ID NO: 18130 - protein, 19 aa, Brucella spp.
GAAVLRVFVPDTTWNVQVQ

SEQ ID NO: 18131 - protein, 23 aa, Brucella spp.
PDTTWNVQVQRFFDEAQCEPFEG

SEQ ID NO: 18132 - protein, 18 aa, Brucella spp.
LEEAPRRLVLALANEPVE

SEQ ID NO: 18133 - protein, 25 aa, Brucella spp.
ANEPVEISAPLLLRSPLLRPSDLVD

SEQ ID NO: 18134 - protein, 21 aa, Brucella spp.
SDDVLLRGVLRSFADAAIDRT

SEQ ID NO: 18135 - protein, 19 aa, Brucella spp.
IPDLSVASGPLMRENHSER

SEQ ID NO: 18136 - protein, 20 aa, Brucella spp.
RTALADALDISFDRADAIIG

SEQ ID NO: 18137 - protein, 25 aa, Brucella spp.
IIGKWPDSYLPIALKALGLSAPECY

SEQ ID NO: 18138 - protein, 20 aa, Brucella spp.
SAPECYLVMTAVLGSIETTR

SEQ ID NO: 18139 - protein, 20 aa, Brucella spp.
IDRAKAMSLVRRWKSDDMPA

SEQ ID NO: 18140 - protein, 25 aa, Brucella spp.
ALIRKVRGGGGFAYLARRGSPEAGA

SEQ ID NO: 18141 - protein, 22 aa, Brucella spp.
SLAARLLHFFFTSASVLAIAAG

SEQ ID NO: 18142 - protein, 24 aa, Brucella spp.
GGATAFLVVMGFVSANALWYQPEA

SEQ ID NO: 18143 - protein, 25 aa, Brucella spp.
WYQPEAHDAVFFRTRPDFVFKPTPR

SEQ ID NO: 18144 - protein, 17 aa, Brucella spp.
VEHWRALQQKLGVKQAS

SEQ ID NO: 18145 - protein, 24 aa, Brucella spp.
EAVREFQKLFGLHVTGEIDSALIS

SEQ ID NO: 18146 - protein, 23 aa, Brucella spp.
AFWLSLAFIAVPHFFPADQENKA

SEQ ID NO: 18147 - protein, 24 aa, Brucella spp.
NGHWSYDLNRHIALKQALDVLEGR

SEQ ID NO: 18148 - protein, 20 aa, Brucella spp.
EGEGKAYFRLASADHAPNHN

SEQ ID NO: 18149 - protein, 22 aa, Brucella spp.
DHAPNHNLLIWGYDDKGSEFYK

SEQ ID NO: 18150 - protein, 20 aa, Brucella spp.
EETDPGFFLGVGGSALDDYI

SEQ ID NO: 18151 - protein, 17 aa, Brucella spp.
DIAPGGDVFYILTNADG

SEQ ID NO: 18152 - protein, 24 aa, Brucella spp.
PAFDGELVPVSLLYHKDTKLDGSA

SEQ ID NO: 18153 - protein, 20 aa, Brucella spp.
DGSAPCLLYGYGSYGITIPA

SEQ ID NO: 18154 - protein, 18 aa, Brucella spp.
LSLVDRGFVYAIAHIRGG

SEQ ID NO: 18155 - protein, 20 aa, Brucella spp.
VDRGFVYAIAHIRGGKDKGF

SEQ ID NO: 18156 - protein, 22 aa, Brucella spp.
GIIAEVPFVDVLNTMLDDTLPL

SEQ ID NO: 18157 - protein, 18 aa, Brucella spp.
PPEWPEWGNPIASEADYR

SEQ ID NO: 18158 - protein, 22 aa, Brucella spp.
KTDSHPVLFRINMDAGHAGASG

SEQ ID NO: 18159 - protein, 25 aa, Brucella spp.
FSRLEEVAYSFAFALKVVGKVPSFK

SEQ ID NO: 18160 - protein, 26 aa, Brucella spp.
RAKQLEYSWVLSLMGAYSDFWKLTEE

SEQ ID NO: 18161 - protein, 19 aa, Brucella spp.
KLTEESLDYALAHYPSVDP

SEQ ID NO: 18162 - protein, 18 aa, Brucella spp.
LDCYPEVPAALKALKDRG

SEQ ID NO: 18163 - protein, 24 aa, Brucella spp.
FPRPSFCQACIFWIESQKFEPDFY

SEQ ID NO: 18164 - protein, 17 aa, Brucella spp.
PTGEMPGTIVIDTANRF

SEQ ID NO: 18165 - protein, 21 aa, Brucella spp.
GEMPGTIVIDTANRFCYLVLD

SEQ ID NO: 18166 - protein, 19 aa, Brucella spp.
EGFAWSGRAVIQYKRQWPR

SEQ ID NO: 18167 - protein, 24 aa, Brucella spp.
LKNPLGARALYIFKDGKDTLYRLH

SEQ ID NO: 18168 - protein, 22 aa, Brucella spp.
RLHGNPEWWSIGKAVSSGCVRF

SEQ ID NO: 18169 - protein, 24 aa, Brucella spp.
ATAEKAVGMILAFLQKEGPADKVQ

SEQ ID NO: 18170 - protein, 19 aa, Brucella spp.
DSDVVRFGMTVELENLDDG

SEQ ID NO: 18171 - protein, 25 aa, Brucella spp.
GKISHVAPVSILLFGKPVGDVVKIN

SEQ ID NO: 18172 - protein, 19 aa, Brucella spp.
IERPTFPRSAIKSIQALPL

SEQ ID NO: 18173 - protein, 18 aa, Brucella spp.
LVESGAADAFGFENADLA

SEQ ID NO: 18174 - protein, 27 aa, Brucella spp.
DSTALECGSHWPFQQPVLVKLAQSGRQ

SEQ ID NO: 18175 - protein, 18 aa, Brucella spp.
FQQPVLVKLAQSGRQPTP

SEQ ID NO: 18176 - protein, 22 aa, Brucella spp.
LIHACMAEPFYVAGTKRACTEL

SEQ ID NO: 18177 - protein, 23 aa, Brucella spp.
RACTELMRMAPGRIFVKTGAEGV

SEQ ID NO: 18178 - protein, 26 aa, Brucella spp.
FCGSVPELGFGFAMKCDDGATRASEA

SEQ ID NO: 18179 - protein, 20 aa, Brucella spp.
EAMVAAVLSRLFRKDEALSA

SEQ ID NO: 18180 - protein, 20 aa, Brucella spp.
ASPEMKNWNGIPLGSVTPAA

SEQ ID NO: 18181 - protein, 22 aa, Brucella spp.
PHERIAAIIAVNFSATQFAQET

SEQ ID NO: 18182 - protein, 23 aa, Brucella spp.
FAQETIAAWLTFYVHAQQSDDIK

SEQ ID NO: 18183 - protein, 21 aa, Brucella spp.
RRLHSNLVFALEQLTSRARAN

SEQ ID NO: 18184 - protein, 18 aa, Brucella spp.
AYAAALKAQGEWAALKPV

SEQ ID NO: 18185 - protein, 19 aa, Brucella spp.
KAQGEWAALKPVERGRILR

SEQ ID NO: 18186 - protein, 23 aa, Brucella spp.
GEFVELGGSFAYTRREALGICVG

SEQ ID NO: 18187 - protein, 20 aa, Brucella spp.
REALGICVGIGAWNYPIQIA

SEQ ID NO: 18188 - protein, 23 aa, Brucella spp.
VGIGAWNYPIQIAAWKSAPALAM

SEQ ID NO: 18189 - protein, 20 aa, Brucella spp.
KSAPALAMGNAFIFKPSENT

SEQ ID NO: 18190 - protein, 22 aa, Brucella spp.
YKEAGLPDGLFNVVQGYGDVGA

SEQ ID NO: 18191 - protein, 19 aa, Brucella spp.
VTMELGGKSPLIVFDDADL

SEQ ID NO: 18192 - protein, 18 aa, Brucella spp.
ERTRKIRIGDPFDEATQM

SEQ ID NO: 18193 - protein, 19 aa, Brucella spp.
EEIFGPVMSVLEFSDEDEV

SEQ ID NO: 18194 - protein, 23 aa, Brucella spp.
ANLARGRLYQFDFILPDNENTFM

SEQ ID NO: 18195 - protein, 24 aa, Brucella spp.
LPDNENTFMLSLRSELYAASERAL

SEQ ID NO: 18196 - protein, 26 aa, Brucella spp.
ERVRINLRLVPAFDEAALVAALDESA

SEQ ID NO: 18197 - protein, 23 aa, Brucella spp.
ADFPDREILPVLEGFDKDPQVEK

SEQ ID NO: 18198 - protein, 22 aa, Brucella spp.
AIVPGQEYIRIEIFLKDNLPRF

SEQ ID NO: 18199 - protein, 20 aa, Brucella spp.
SEQDPAQWIKACRTAIEALR

SEQ ID NO: 18200 - protein, 23 aa, Brucella spp.
HPKEFSAITGIGLSGQMHGATLL

SEQ ID NO: 18201 - protein, 18 aa, Brucella spp.
LRPCILWNDTRSYREAAE

SEQ ID NO: 18202 - protein, 17 aa, Brucella spp.
FTAPKLVWVARNEADIF

SEQ ID NO: 18203 - protein, 22 aa, Brucella spp.
NEADIFARIRKVLLPKDYLRLW

SEQ ID NO: 18204 - protein, 25 aa, Brucella spp.
RIRKVLLPKDYLRLWLTGEYISDMS

SEQ ID NO: 18205 - protein, 17 aa, Brucella spp.
DTGARRWSAELLAKTGL

SEQ ID NO: 18206 - protein, 25 aa, Brucella spp.
GCLRAELAAEWSLTASVIVAGGAGD

SEQ ID NO: 18207 - protein, 20 aa, Brucella spp.
FCHALPRTWHQMGVILSAAS

SEQ ID NO: 18208 - protein, 19 aa, Brucella spp.
AASALEWYSKIVGATPQSL

SEQ ID NO: 18209 - protein, 23 aa, Brucella spp.
ETLKAPGSVTFLPYLSGERTPYN

SEQ ID NO: 18210 - protein, 25 aa, Brucella spp.
IALPEEGDFGAAFGAARLGLIAATG

SEQ ID NO: 18211 - protein, 26 aa, Brucella spp.
EDHLRFAVAYWHSFAWEGGDPFGGRT

SEQ ID NO: 18212 - protein, 20 aa, Brucella spp.
FAWEGGDPFGGRTFDRPWFS

SEQ ID NO: 18213 - protein, 23 aa, Brucella spp.
LKADVAFEFFSLLGAPYYCFHDA

SEQ ID NO: 18214 - protein, 18 aa, Brucella spp.
FFSLLGAPYYCFHDADVR

SEQ ID NO: 18215 - protein, 19 aa, Brucella spp.
TGMKLLWGTANLFSNRRYM

SEQ ID NO: 18216 - protein, 20 aa, Brucella spp.
RLGGENYVLWGGREGYETLL

SEQ ID NO: 18217 - protein, 17 aa, Brucella spp.
DHMGRFLSLVVEYKHKI

SEQ ID NO: 18218 - protein, 23 aa, Brucella spp.
LVVEYKHKIGFKGTILIEPKPQE

SEQ ID NO: 18219 - protein, 24 aa, Brucella spp.
QYDYDVATVYGFLKRYGLENEVKV

SEQ ID NO: 18220 - protein, 24 aa, Brucella spp.
SFEHELALARTLGIFGSIDMNRND

SEQ ID NO: 18221 - protein, 18 aa, Brucella spp.
NVPEMALAYYQVLLAGGF

SEQ ID NO: 18222 - protein, 19 aa, Brucella spp.
PFNTWDGITRWAAEKGYAG

SEQ ID NO: 18223 - protein, 30 aa, Brucella spp.
GAHATFSGALAWPFVYPWPQRPAGLVETAF

SEQ ID NO: 18224 - protein, 17 aa, Brucella spp.
GLVETAFDELARRWMPI

SEQ ID NO: 18225 - protein, 23 aa, Brucella spp.
REGAEFVRAHIIRVTDKAFDDFA

SEQ ID NO: 18226 - protein, 17 aa, Brucella spp.
QADVIHYHFPWPMSDIV

SEQ ID NO: 18227 - protein, 25 aa, Brucella spp.
DVIHYHFPWPMSDIVQIGVRPDKPT

SEQ ID NO: 18228 - protein, 19 aa, Brucella spp.
IVKQKLLLQFYRPLMNRFL

SEQ ID NO: 18229 - protein, 29 aa, Brucella spp.
RWRERFPRPFFLFVGVLRYYKGLRTLLAA

SEQ ID NO: 18230 - protein, 25 aa, Brucella spp.
TALLELSAGLIFPSHLRSEAFGLSL

SEQ ID NO: 18231 - protein, 19 aa, Brucella spp.
EAFGLSLVEASMFGKPMIS

SEQ ID NO: 18232 - protein, 20 aa, Brucella spp.
HNDALPLWLSAGVDAPNSGF

SEQ ID NO: 18233 - protein, 18 aa, Brucella spp.
QIYCFAKAGAMGWQGEWK

SEQ ID NO: 18234 - protein, 18 aa, Brucella spp.
QTVEAGIEYYDRVYRRED

SEQ ID NO: 18235 - protein, 22 aa, Brucella spp.
PHMHLFEAMLAWETVDPETQFW

SEQ ID NO: 18236 - protein, 25 aa, Brucella spp.
VEPGHQFEWSWLMGQWADRRQNGDG

SEQ ID NO: 18237 - protein, 20 aa, Brucella spp.
TEWIKSALLFASLSKDEERV

SEQ ID NO: 18238 - protein, 18 aa, Brucella spp.
IDALRPFLETPIKGLWYD

SEQ ID NO: 18239 - protein, 18 aa, Brucella spp.
KQFLALTGELSLFQMTLK

SEQ ID NO: 18240 - protein, 20 aa, Brucella spp.
TGELSLFQMTLKRLSDPNRY

SEQ ID NO: 18241 - protein, 17 aa, Brucella spp.
ARMGRLATFGITPTEPA

SEQ ID NO: 18242 - protein, 17 aa, Brucella spp.
TPTEPATGFGYIEAGEL

SEQ ID NO: 18243 - protein, 19 aa, Brucella spp.
EPATGFGYIEAGELEESGA

SEQ ID NO: 18244 - protein, 17 aa, Brucella spp.
LEESGACAIKRFVEKPK

SEQ ID NO: 18245 - protein, 18 aa, Brucella spp.
ESGACAIKRFVEKPKEEV

SEQ ID NO: 18246 - protein, 28 aa, Brucella spp.
KEEVAREMLAAGGFYWNSGMFLFRSDVF

SEQ ID NO: 18247 - protein, 24 aa, Brucella spp.
FEKAPDISVDYAIFEKTKLASVVP

SEQ ID NO: 18248 - protein, 25 aa, Brucella spp.
VPSPIHWSDLGSWDAVWKESKQDPS

SEQ ID NO: 18249 - protein, 17 aa, Brucella spp.
SNFQGPAGRLFWSQTVL

SEQ ID NO: 18250 - protein, 19 aa, Brucella spp.
DRIDVFWGPAHRLPALKGA

SEQ ID NO: 18251 - protein, 25 aa, Brucella spp.
ANLPECVRNNFLLVVAGGKGWNLGD

SEQ ID NO: 18252 - protein, 27 aa, Brucella spp.
TLLMPSLYEGFGLPIIEAQAYGVPVIT

SEQ ID NO: 18253 - protein, 18 aa, Brucella spp.
VYSPYLCGNFKKYVNECL

SEQ ID NO: 18254 - protein, 22 aa, Brucella spp.
YVNECLDTGWISSRGEFISRFE

SEQ ID NO: 18255 - protein, 18 aa, Brucella spp.
RFEDAFAQYVDVPSAASV

SEQ ID NO: 18256 - protein, 19 aa, Brucella spp.
EVIVPTFTYIASVNTILQT

SEQ ID NO: 18257 - protein, 27 aa, Brucella spp.
SHVGTFGDVATFSFFGNKTITTGEGGM

SEQ ID NO: 18258 - protein, 22 aa, Brucella spp.
EYWHDALAYNYRMTNIQAAIGL

SEQ ID NO: 18259 - protein, 18 aa, Brucella spp.
LAGLPLRMHTPVGDVKHS

SEQ ID NO: 18260 - protein, 19 aa, Brucella spp.
VDTRPFFPPAHRMPHSAST

SEQ ID NO: 18261 - protein, 25 aa, Brucella spp.
HITDVEISFVCDLVRSYFSNHSNHI

SEQ ID NO: 18262 - protein, 25 aa, Brucella spp.
SALLCGIGLFLLSHLLPANFLAARM

SEQ ID NO: 18263 - protein, 18 aa, Brucella spp.
FLCLSGASLLLWVVGGLD

SEQ ID NO: 18264 - protein, 22 aa, Brucella spp.
PDFRLLPNLLPYWLEATLIVFA

SEQ ID NO: 18265 - protein, 24 aa, Brucella spp.
LPYWLEATLIVFALIIAINVTNFM

SEQ ID NO: 18266 - protein, 17 aa, Brucella spp.
THIVVALVLPLYYILDA

SEQ ID NO: 18267 - protein, 40 aa, Brucella spp.
LLLLASAYLAFVVRFGFVFVPNLAQLFLILIAPLLAIPVF

SEQ ID NO: 18268 - protein, 28 aa, Brucella spp.
IAPLLAIPVFIRFGLYRAIIRYLAERAI

SEQ ID NO: 18269 - protein, 17 aa, Brucella spp.
VFLMELYGSTGLPRSVP

SEQ ID NO: 18270 - protein, 26 aa, Brucella spp.
STGLPRSVPLLYWLLSTVFISASRFG

SEQ ID NO: 18271 - protein, 18 aa, Brucella spp.
ISASRFGAKWLLRTAEHD

SEQ ID NO: 18272 - protein, 17 aa, Brucella spp.
SRFGAKWLLRTAEHDKR

SEQ ID NO: 18273 - protein, 18 aa, Brucella spp.
TIAQWNPAAIVLFESSEF

SEQ ID NO: 18274 - protein, 23 aa, Brucella spp.
ATKRWAELVVYYYGRLAEQAGKK

SEQ ID NO: 18275 - protein, 17 aa, Brucella spp.
QSFAAPIDIMMMERHPF

SEQ ID NO: 18276 - protein, 28 aa, Brucella spp.
HPFGSQAFIPLNGRPFLVVVAEDAGAGP

SEQ ID NO: 18277 - protein, 26 aa, Brucella spp.
VLVKDRIPATIFVTGRWIKQNAEAVA

SEQ ID NO: 18278 - protein, 25 aa, Brucella spp.
HVPAITNMPLMYGIKTAGSLDAVRK

SEQ ID NO: 18279 - protein, 19 aa, Brucella spp.
GMPKPLWYRDATARYSTDA

SEQ ID NO: 18280 - protein, 24 aa, Brucella spp.
MSSLGLPVPPGFTITTEVCTYYYN

SEQ ID NO: 18281 - protein, 17 aa, Brucella spp.
GMMDTVLNLGLNDETVQ

SEQ ID NO: 18282 - protein, 24 aa, Brucella spp.
GDERFAYDSYRRFIQMYSDVVLGV

SEQ ID NO: 18283 - protein, 20 aa, Brucella spp.
LSADDWKNVIGLYKAKVEEE

SEQ ID NO: 18284 - protein, 17 aa, Brucella spp.
WKNVIGLYKAKVEEELG

SEQ ID NO: 18285 - protein, 25 aa, Brucella spp.
ITYRRLHNIPAAWGTAVNVQAMVFG

SEQ ID NO: 18286 - protein, 20 aa, Brucella spp.
EKVMPEAFAEFLKVANRLEQ

SEQ ID NO: 18287 - protein, 23 aa, Brucella spp.
LEFTIERGKLWMLQTRSGKRTAR

SEQ ID NO: 18288 - protein, 19 aa, Brucella spp.
LKMAVEMAAEGLISEEEAV

SEQ ID NO: 18289 - protein, 22 aa, Brucella spp.
GKPCVSGAGSLRVDYRNGTMLA

SEQ ID NO: 18290 - protein, 22 aa, Brucella spp.
ELSGDFGKLMEWADRARRMKVR

SEQ ID NO: 18291 - protein, 24 aa, Brucella spp.
EEGRRLALGKLLPMQRSDFAELFE

SEQ ID NO: 18292 - protein, 22 aa, Brucella spp.
QRSDFAELFEIMKGLPVTIRLL

SEQ ID NO: 18293 - protein, 27 aa, Brucella spp.
LFEIMKGLPVTIRLLDPPLHEFLPHTD

SEQ ID NO: 18294 - protein, 19 aa, Brucella spp.
MLGHRGCRLAVSYPEIAEM

SEQ ID NO: 18295 - protein, 19 aa, Brucella spp.
LKAELDFVKARIDAVAKEV

SEQ ID NO: 18296 - protein, 19 aa, Brucella spp.
SEAGIKIDYMVGTMIELPR

SEQ ID NO: 18297 - protein, 18 aa, Brucella spp.
KIDYMVGTMIELPRAALR

SEQ ID NO: 18298 - protein, 17 aa, Brucella spp.
IELPRAALRAAEIAESA

SEQ ID NO: 18299 - protein, 18 aa, Brucella spp.
SAEFFSFGTNDLTQTTFG

SEQ ID NO: 18300 - protein, 17 aa, Brucella spp.
RDDAAGFLTTYQNRVVI

SEQ ID NO: 18301 - protein, 20 aa, Brucella spp.
RVVIEQDPFVSLDVDGVGEL

SEQ ID NO: 18302 - protein, 22 aa, Brucella spp.
YVSCSPFRVPIARLAAAQAAVR

SEQ ID NO: 18303 - protein, 27 aa, Brucella spp.
KNTPISRLWIAFGLTGIFMIAEVIGSF

SEQ ID NO: 18304 - protein, 18 aa, Brucella spp.
FALLLALIAIYLGRRPAD

SEQ ID NO: 18305 - protein, 19 aa, Brucella spp.
ALLLLGVAFYILYEAWERL

SEQ ID NO: 18306 - protein, 23 aa, Brucella spp.
WVDSAIAVGIGFMVFPRTWVLLK

SEQ ID NO: 18307 - protein, 23 aa, Brucella spp.
PHCADFKLITFPKIKEKYIDTGK

SEQ ID NO: 18308 - protein, 19 aa, Brucella spp.
TGKARLIFRDFPFDPRATA

SEQ ID NO: 18309 - protein, 18 aa, Brucella spp.
IFRDFPFDPRATAAVMLA

SEQ ID NO: 18310 - protein, 20 aa, Brucella spp.
PEDHYFPMIDLFFRQQQQWA

SEQ ID NO: 18311 - protein, 18 aa, Brucella spp.
VADPYRVWLSEIMLQQTT

SEQ ID NO: 18312 - protein, 24 aa, Brucella spp.
TTVEAVKSYFLRFIERWPTVRAMA

SEQ ID NO: 18313 - protein, 25 aa, Brucella spp.
KASEDDILRAWAGLGYYSRARNLKK

SEQ ID NO: 18314 - protein, 18 aa, Brucella spp.
LCGEALPTVMKKAIAAAI

SEQ ID NO: 18315 - protein, 17 aa, Brucella spp.
KAIAAAIPDAFKRGRKS

SEQ ID NO: 18316 - protein, 24 aa, Brucella spp.
HYDPELAFLDIIPDAGERRWFLEN

SEQ ID NO: 18317 - protein, 17 aa, Brucella spp.
VEILRGLIAAGHDVTML

SEQ ID NO: 18318 - protein, 18 aa, Brucella spp.
AQARFPFLTESRGVTVSG

SEQ ID NO: 18319 - protein, 17 aa, Brucella spp.
DCVSALERLSDHSVDVI

SEQ ID NO: 18320 - protein, 24 aa, Brucella spp.
AYDAFTRAWLLACRRVLKPNGTIW

SEQ ID NO: 18321 - protein, 19 aa, Brucella spp.
QDLGFWLLNDIVWRKTNPM

SEQ ID NO: 18322 - protein, 18 aa, Brucella spp.
SDWLFPICTGSERLKDEN

SEQ ID NO: 18323 - protein, 18 aa, Brucella spp.
QKPEALLARIMMASSKPG

SEQ ID NO: 18324 - protein, 22 aa, Brucella spp.
FDACNGWTFWHFEENGVLKPID

SEQ ID NO: 18325 - protein, 19 aa, Brucella spp.
RGSEIGIVIAGALIGILSG

SEQ ID NO: 18326 - protein, 25 aa, Brucella spp.
GGILMGVLIWVLARWRKRPIVDPIE

SEQ ID NO: 18327 - protein, 17 aa, Brucella spp.
LSLTDSFILVGQNLISK

SEQ ID NO: 18328 - protein, 22 aa, Brucella spp.
PRDYVPALMLGFISAGIAILIM

SEQ ID NO: 18329 - protein, 18 aa, Brucella spp.
NITIPVLVLLILTKSLAS

SEQ ID NO: 18330 - protein, 17 aa, Brucella spp.
IPVLVLLILTKSLASAV

SEQ ID NO: 18331 - protein, 27 aa, Brucella spp.
FLALEMTGDFPISMLVLGAVVSSSLMV

SEQ ID NO: 18332 - protein, 18 aa, Brucella spp.
SAHDIGWIRDLTVARMMR

SEQ ID NO: 18333 - protein, 20 aa, Brucella spp.
LEPTDTWAIFDTTADVPAMM

SEQ ID NO: 18334 - protein, 20 aa, Brucella spp.
VPAMMGTRLLIGLTEKEAEE

SEQ ID NO: 18335 - protein, 21 aa, Brucella spp.
SSLFPVFATVLLASLAGCTTS

SEQ ID NO: 18336 - protein, 23 aa, Brucella spp.
MPHVESVALGIWVKAGARNEAPD

SEQ ID NO: 18337 - protein, 21 aa, Brucella spp.
DRHGIAHLLEHMAFKGTENRT

SEQ ID NO: 18338 - protein, 21 aa, Brucella spp.
FKGTENRTAWQIASDIENVGG

SEQ ID NO: 18339 - protein, 23 aa, Brucella spp.
LRNDMPLAIDILSDILTASKFDE

SEQ ID NO: 18340 - protein, 17 aa, Brucella spp.
LDLAHYVGGDFRENREL

SEQ ID NO: 18341 - protein, 24 aa, Brucella spp.
NRELMDAQVLIGFEGRAYHVRDFY

SEQ ID NO: 18342 - protein, 22 aa, Brucella spp.
VRDFYASQLLSMILGGGMSSRL

SEQ ID NO: 18343 - protein, 21 aa, Brucella spp.
REKRGLCYSVYAFHWGFSDTG

SEQ ID NO: 18344 - protein, 26 aa, Brucella spp.
VYAFHWGFSDTGLFGIHAATGRDELV

SEQ ID NO: 18345 - protein, 23 aa, Brucella spp.
ASRAGQIARQFLLYGRPVENSEL

SEQ ID NO: 18346 - protein, 17 aa, Brucella spp.
LDRLSLITPERLTDLAG

SEQ ID NO: 18347 - protein, 23 aa, Brucella spp.
ITPERLTDLAGRLFLNNKPTIAG

SEQ ID NO: 18348 - protein, 22 aa, Brucella spp.
HSDEGAMGFIINQLQPVQFPDL

SEQ ID NO: 18349 - protein, 20 aa, Brucella spp.
PVQFPDLLRQIGVIGEEDLI

SEQ ID NO: 18350 - protein, 28 aa, Brucella spp.
VRGALQIELRPGWKTYWRNPGDAGVPPQ

SEQ ID NO: 18351 - protein, 24 aa, Brucella spp.
AKAQIAFPAPVRFAGDEEGGIGYK

SEQ ID NO: 18352 - protein, 25 aa, Brucella spp.
IGYKKPVSLPVTFHIEPGGKRLKGH

SEQ ID NO: 18353 - protein, 20 aa, Brucella spp.
KRLKGHAFLGMCENICVPVL

SEQ ID NO: 18354 - protein, 26 aa, Brucella spp.
CENICVPVLAEFDFPLDADRQKSSSE

SEQ ID NO: 18355 - protein, 18 aa, Brucella spp.
DDVFKGRKVVLFAVPGAF

SEQ ID NO: 18356 - protein, 21 aa, Brucella spp.
FKGRKVVLFAVPGAFTPTCSL

SEQ ID NO: 18357 - protein, 18 aa, Brucella spp.
LFAVPGAFTPTCSLNHLP

SEQ ID NO: 18358 - protein, 17 aa, Brucella spp.
TGGEGKILFLADGSATF

SEQ ID NO: 18359 - protein, 21 aa, Brucella spp.
GEGKILFLADGSATFTKAAGL

SEQ ID NO: 18360 - protein, 24 aa, Brucella spp.
NPGPGGWGALLRWNGNEKELKGGE

SEQ ID NO: 18361 - protein, 22 aa, Brucella spp.
ARKAHKVTWHWIKGHAGHPENE

SEQ ID NO: 18362 - protein, 30 aa, Brucella spp.
EIRLCGPRGFCAGVDRAIQIVVLALKKYGA

SEQ ID NO: 18363 - protein, 17 aa, Brucella spp.
ADAEAKNLFYLDATCPL

SEQ ID NO: 18364 - protein, 19 aa, Brucella spp.
EAKNLFYLDATCPLVSKVH

SEQ ID NO: 18365 - protein, 17 aa, Brucella spp.
FPNLAAPAAESICYATT

SEQ ID NO: 18366 - protein, 18 aa, Brucella spp.
IIVDEIIDAFKARFDVKI

SEQ ID NO: 18367 - protein, 20 aa, Brucella spp.
IDAFKARFDVKIELAETTVE

SEQ ID NO: 18368 - protein, 20 aa, Brucella spp.
LNVVTPWIFFIGLAIVLYCM

SEQ ID NO: 18369 - protein, 23 aa, Brucella spp.
IASEVMFFVAWFWAFFDASLFPN

SEQ ID NO: 18370 - protein, 27 aa, Brucella spp.
WYWHFVDVVWLFLFFAIYVWGGWGAPM

SEQ ID NO: 18371 - protein, 21 aa, Brucella spp.
TWDSLVLFMIIFLWTPPHFWA

SEQ ID NO: 18372 - protein, 18 aa, Brucella spp.
ARKLFRFSLLYLAGIFAV

SEQ ID NO: 18373 - protein, 20 aa, Brucella spp.
KDIGTLYLIFAIIAGTIGGA

SEQ ID NO: 18374 - protein, 23 aa, Brucella spp.
MAFPRMNNISFWLLPPALTLLLI

SEQ ID NO: 18375 - protein, 21 aa, Brucella spp.
LHKMPLFAWAVLVTAFLLLLS

SEQ ID NO: 18376 - protein, 19 aa, Brucella spp.
PILYQHLFWFFGHPEVYIL

SEQ ID NO: 18377 - protein, 29 aa, Brucella spp.
GSISFRAPMLWAIGFIFLFTIGGVTGVQL

SEQ ID NO: 18378 - protein, 21 aa, Brucella spp.
NEFTAKLHFWVTFVGVNLVFF

SEQ ID NO: 18379 - protein, 17 aa, Brucella spp.
FPQHFLGLAGMPRRYID

SEQ ID NO: 18380 - protein, 19 aa, Brucella spp.
QPRPWEWRFQDAATGIAEQ

SEQ ID NO: 18381 - protein, 24 aa, Brucella spp.
HWFERYTLWFIIPITLLVLGLLVW

SEQ ID NO: 18382 - protein, 29 aa, Brucella spp.
IPITLLVLGLLVWVVLRFRASVNPEPSKT

SEQ ID NO: 18383 - protein, 19 aa, Brucella spp.
IWTVGPVIILLFLAVPSFQ

SEQ ID NO: 18384 - protein, 20 aa, Brucella spp.
SDVIHSWTIPAFGVKMDAVP

SEQ ID NO: 18385 - protein, 21 aa, Brucella spp.
KRPELGLSVVVLKTADNKARI

SEQ ID NO: 18386 - protein, 20 aa, Brucella spp.
NKARILRVLAPLGVLLPNGL

SEQ ID NO: 18387 - protein, 17 aa, Brucella spp.
MLFDIDWQGADQLQAKM

SEQ ID NO: 18388 - protein, 24 aa, Brucella spp.
AKMPADVVSIFILPPTMRELQQRL

SEQ ID NO: 18389 - protein, 21 aa, Brucella spp.
ADGEARIVWEVRSVNGKGLDL

SEQ ID NO: 18390 - protein, 21 aa, Brucella spp.
KGLDLRLRLPQGLESVEHPVR

SEQ ID NO: 18391 - protein, 19 aa, Brucella spp.
HPVRSLLARHFSRGNFQAS

SEQ ID NO: 18392 - protein, 20 aa, Brucella spp.
ETQAGFAINQPMLAEVLKLG

SEQ ID NO: 18393 - protein, 21 aa, Brucella spp.
LKLGAELQEKYGLAPASVDGI

SEQ ID NO: 18394 - protein, 17 aa, Brucella spp.
APASVDGILALRGIIDQ

SEQ ID NO: 18395 - protein, 19 aa, Brucella spp.
ASVDGILALRGIIDQSQRA

SEQ ID NO: 18396 - protein, 20 aa, Brucella spp.
RAALEATIVAAFEGALKAIA

SEQ ID NO: 18397 - protein, 18 aa, Brucella spp.
ATIVAAFEGALKAIAEAR

SEQ ID NO: 18398 - protein, 21 aa, Brucella spp.
RQEGKALFTILSTHLDTIERL

SEQ ID NO: 18399 - protein, 25 aa, Brucella spp.
EAIKARLAGQVALLLDATRELDETR

SEQ ID NO: 18400 - protein, 21 aa, Brucella spp.
GGPVGRKLDFLSQEFNREANT

SEQ ID NO: 18401 - protein, 17 aa, Brucella spp.
APIAPWRQQDRGDGVNS

SEQ ID NO: 18402 - protein, 42 aa, Brucella spp.
ARSQIVVFMNFMLSLVVLVLLGASALFYFGKLQFDAQGPLTA

SEQ ID NO: 18403 - protein, 23 aa, Brucella spp.
RDIVSDARIFRYGMRTLGHENDL

SEQ ID NO: 18404 - protein, 23 aa, Brucella spp.
KAGEYAIPVGASMRDVMNILISG

SEQ ID NO: 18405 - protein, 18 aa, Brucella spp.
SIMYPFTVPEGLTVKQVF

SEQ ID NO: 18406 - protein, 26 aa, Brucella spp.
PFTVPEGLTVKQVFDRIAADPILIGD

SEQ ID NO: 18407 - protein, 18 aa, Brucella spp.
PPEGSLFTDTLNFTRGTT

SEQ ID NO: 18408 - protein, 21 aa, Brucella spp.
PVRDKNEFVTLASIVEKETGI

SEQ ID NO: 18409 - protein, 20 aa, Brucella spp.
ERPHVASVFVNRLNKGMRLQ

SEQ ID NO: 18410 - protein, 24 aa, Brucella spp.
RLQSDPTIIYGLFGGAGKPSDRPI

SEQ ID NO: 18411 - protein, 26 aa, Brucella spp.
NGGKFGKVENWGLRPLTYRIKKNRKA

SEQ ID NO: 18412 - protein, 22 aa, Brucella spp.
RINEDVLSFLTVRVEEHEEGQS

SEQ ID NO: 18413 - protein, 24 aa, Brucella spp.
KVKDGYARNFLLPQGKALRANEAN

SEQ ID NO: 18414 - protein, 18 aa, Brucella spp.
KLNGESFIVVRSAGETGQ

SEQ ID NO: 18415 - protein, 23 aa, Brucella spp.
RDIAEIITANGFTLHRNQVELNH

SEQ ID NO: 18416 - protein, 17 aa, Brucella spp.
ELNHPIKTIGLHEVSVS

SEQ ID NO: 18417 - protein, 18 aa, Brucella spp.
PEVQVKVMVNIARSTEEA

SEQ ID NO: 18418 - protein, 21 aa, Brucella spp.
GEDLTSIEAIYGIEEQPLSEE

SEQ ID NO: 18419 - protein, 19 aa, Brucella spp.
AFNPELKLAECFMDGEIDF

SEQ ID NO: 18420 - protein, 20 aa, Brucella spp.
LEGDIYTLLQVVFENTGPTV

SEQ ID NO: 18421 - protein, 31 aa, Brucella spp.
EGDKVLDIGCGWGGMGLYLARHLKANVTGVT

SEQ ID NO: 18422 - protein, 17 aa, Brucella spp.
LYLARHLKANVTGVTLS

SEQ ID NO: 18423 - protein, 21 aa, Brucella spp.
LMKPDGVFLLHAIGRSDGPGA

SEQ ID NO: 18424 - protein, 25 aa, Brucella spp.
TNPFIRKYIFPGGYIPALSEVLPHI

SEQ ID NO: 18425 - protein, 22 aa, Brucella spp.
LRLHYAETLKAWREAFLANRDK

SEQ ID NO: 18426 - protein, 17 aa, Brucella spp.
EFYLAASESAFRWQNMM

SEQ ID NO: 18427 - protein, 19 aa, Brucella spp.
SESAFRWQNMMVFHIQITH

SEQ ID NO: 18428 - protein, 20 aa, Brucella spp.
AEQALLGAILINNDAFYRVS

SEQ ID NO: 18429 - protein, 23 aa, Brucella spp.
EGKVGDLSIFQYVTRLATEAVTI

SEQ ID NO: 18430 - protein, 17 aa, Brucella spp.
ANGGVVGFFSLEMSAEQ

SEQ ID NO: 18431 - protein, 17 aa, Brucella spp.
VMQKIPLYIDQTGGISI

SEQ ID NO: 18432 - protein, 18 aa, Brucella spp.
LYIDQTGGISIAQLAARA

SEQ ID NO: 18433 - protein, 17 aa, Brucella spp.
QRGLDVLVIDYVQLMTG

SEQ ID NO: 18434 - protein, 20 aa, Brucella spp.
ELNVPIIALSQLSRQVESRD

SEQ ID NO: 18435 - protein, 24 aa, Brucella spp.
IEQDADVVLFVFREEYYVKNLEPR

SEQ ID NO: 18436 - protein, 24 aa, Brucella spp.
TGTVKLAFQSEFTRFADLADGSYL

SEQ ID NO: 18437 - protein, 18 aa, Brucella spp.
IEDAPRIISGISELDRVT

SEQ ID NO: 18438 - protein, 18 aa, Brucella spp.
ISELDRVTGGGFVRGSAL

SEQ ID NO: 18439 - protein, 19 aa, Brucella spp.
PDLVIIDSIQTLWTDMADS

SEQ ID NO: 18440 - protein, 17 aa, Brucella spp.
GHHYRILRTVKNRFGPT

SEQ ID NO: 18441 - protein, 20 aa, Brucella spp.
EKSPGAAVFAGMEGTRPVLV

SEQ ID NO: 18442 - protein, 20 aa, Brucella spp.
RPVLVEIQALVAPSSLGTPR

SEQ ID NO: 18443 - protein, 27 aa, Brucella spp.
RAVVGWDGGRLAMILAVLESHCGVRFG

SEQ ID NO: 18444 - protein, 19 aa, Brucella spp.
VYLNVAGGYRISEPAADIA

SEQ ID NO: 18445 - protein, 22 aa, Brucella spp.
IALPPDCVYFGEISLSGAVRAV

SEQ ID NO: 18446 - protein, 22 aa, Brucella spp.
QRLKEAEKLGFRQAEVPNGSGE

SEQ ID NO: 18447 - protein, 25 aa, Brucella spp.
GSGELWKDRNFRLMETAALADLVAR

SEQ ID NO: 18448 - protein, 17 aa, Brucella spp.
METAALADLVARIAASG

SEQ ID NO: 18449 - protein, 24 aa, Brucella spp.
RGFSREVLSLVSWAAAAAAAVLLY

SEQ ID NO: 18450 - protein, 25 aa, Brucella spp.
RIGALDRTLGFLFGAARGVLLVVVA

SEQ ID NO: 18451 - protein, 22 aa, Brucella spp.
HEECGVFGILGHEDAAALTALG

SEQ ID NO: 18452 - protein, 17 aa, Brucella spp.
VGGIAIAHNGNFTNGIT

SEQ ID NO: 18453 - protein, 23 aa, Brucella spp.
LIAARDPIGIRPLVMGELDGKPI

SEQ ID NO: 18454 - protein, 23 aa, Brucella spp.
CSETCALDIIGAKYIRDVENGEV

SEQ ID NO: 18455 - protein, 25 aa, Brucella spp.
PQPERLCLFEYVYFARPDSVVGGRS

SEQ ID NO: 18456 - protein, 25 aa, Brucella spp.
QASGIPFEYGIIRNHYVGRTFIEPT

SEQ ID NO: 18457 - protein, 18 aa, Brucella spp.
VASPMIFHPDFYGIDTPH

SEQ ID NO: 18458 - protein, 20 aa, Brucella spp.
YIGADSLAFLSIDGLYKAVG

SEQ ID NO: 18459 - protein, 17 aa, Brucella spp.
IGYFLSLELAKRGAHVI

SEQ ID NO: 18460 - protein, 20 aa, Brucella spp.
GTIHERWGKLDILVANAGIL

SEQ ID NO: 18461 - protein, 25 aa, Brucella spp.
EKVMNINVTSVWRLIRSVDPLLRAS

SEQ ID NO: 18462 - protein, 19 aa, Brucella spp.
AHSCRAFWGPYAASKAAVE

SEQ ID NO: 18463 - protein, 25 aa, Brucella spp.
FENRFELAVAMVLLAAFLDGIDGRI

SEQ ID NO: 18464 - protein, 17 aa, Brucella spp.
LVLLPVYFGFLGLMPTR

SEQ ID NO: 18465 - protein, 29 aa, Brucella spp.
RDIVMPLILCVVIYVALLMSFTWQTLSLT

SEQ ID NO: 18466 - protein, 50 aa, Brucella spp.
IHREGYPFIAGFFVVSLMLGWLWDPLFWIGMVLTVWCIYFYRDPERVTPM

SEQ ID NO: 18467 - protein, 17 aa, Brucella spp.
WCIYFYRDPERVTPMDD

SEQ ID NO: 18468 - protein, 19 aa, Brucella spp.
LDLGYEPMTRVSVFMNVFS

SEQ ID NO: 18469 - protein, 22 aa, Brucella spp.
DELSVGERFGLIRFGSRVDVYL

SEQ ID NO: 18470 - protein, 21 aa, Brucella spp.
IAGGLAFYWNSLTRTADAPKV

SEQ ID NO: 18471 - protein, 25 aa, Brucella spp.
AKAVDVPVFDVLRVEADGSVVIAGQ

SEQ ID NO: 18472 - protein, 22 aa, Brucella spp.
ANGDFAVVLDRALSPGDHQLVL

SEQ ID NO: 18473 - protein, 17 aa, Brucella spp.
EAVEIEGSSVFVAGKAK

SEQ ID NO: 18474 - protein, 20 aa, Brucella spp.
VEIEGSSVFVAGKAKDGARV

SEQ ID NO: 18475 - protein, 21 aa, Brucella spp.
AISPEGRFLVQGERPLAIGDY

SEQ ID NO: 18476 - protein, 26 aa, Brucella spp.
VQGERPLAIGDYIIRADLLDGTNRIL

SEQ ID NO: 18477 - protein, 17 aa, Brucella spp.
GDNLWTISKRTYGEGTR

SEQ ID NO: 18478 - protein, 20 aa, Brucella spp.
GEGTRYTTIYLANRDQIRNP

SEQ ID NO: 18479 - protein, 25 aa, Brucella spp.
IRNPDLIWPGQVFVMPKEPLRDNEV

SEQ ID NO: 18480 - protein, 17 aa, Brucella spp.
IIPTFLLDKEASFERAK

SEQ ID NO: 18481 - protein, 19 aa, Brucella spp.
RKPMVFANINNFWQPMLAL

SEQ ID NO: 18482 - protein, 20 aa, Brucella spp.
DGQIYVPFTLPGEVVNVARD

SEQ ID NO: 18483 - protein, 22 aa, Brucella spp.
FEDCGGCALQHWQDEPYRLWKR

SEQ ID NO: 18484 - protein, 19 aa, Brucella spp.
EPYRLWKRELVVGALKGRG

SEQ ID NO: 18485 - protein, 24 aa, Brucella spp.
ARKTEKGVLLGFNRHQSHEIIDIV

SEQ ID NO: 18486 - protein, 18 aa, Brucella spp.
VGALLAPGSGPFKLAATL

SEQ ID NO: 18487 - protein, 20 aa, Brucella spp.
RALTALVIKKDFARLSHEGE

SEQ ID NO: 18488 - protein, 20 aa, Brucella spp.
FGKVPVPIPPGCFLQATAEA

SEQ ID NO: 18489 - protein, 21 aa, Brucella spp.
EETMAALVLAHLGKARRVADL

SEQ ID NO: 18490 - protein, 26 aa, Brucella spp.
RVADLFCGVGTFALRIAEKSAVHAVE

SEQ ID NO: 18491 - protein, 20 aa, Brucella spp.
LMTKELLPYNAVVFDPPRAG

SEQ ID NO: 18492 - protein, 19 aa, Brucella spp.
LLPYNAVVFDPPRAGAEEQ

SEQ ID NO: 18493 - protein, 22 aa, Brucella spp.
IERVTPIDQFLWSAHVEAVAVL

SEQ ID NO: 18494 - protein, 19 aa, Brucella spp.
RLDQLLVERGFFATRSRAR

SEQ ID NO: 18495 - protein, 19 aa, Brucella spp.
VLLERGAHHVIAIDVGHDQ

SEQ ID NO: 18496 - protein, 17 aa, Brucella spp.
RGAHHVIAIDVGHDQLH

SEQ ID NO: 18497 - protein, 18 aa, Brucella spp.
IVSDVSFISLRLALPPAL

SEQ ID NO: 18498 - protein, 25 aa, Brucella spp.
SFISLRLALPPALALAEKGAICALL

SEQ ID NO: 18499 - protein, 30 aa, Brucella spp.
LALAEKGAICALLVKPLFEAGREAIGKGGI

SEQ ID NO: 18500 - protein, 17 aa, Brucella spp.
ALHHVFNTPYDRIIWDV

SEQ ID NO: 18501 - protein, 19 aa, Brucella spp.
AGALDARLIVILNDNDMSI

SEQ ID NO: 18502 - protein, 20 aa, Brucella spp.
SEEYARAFFTGGTLFEELGF

SEQ ID NO: 18503 - protein, 22 aa, Brucella spp.
FGEAFPKRVFDVGIAEQHAVTF

SEQ ID NO: 18504 - protein, 27 aa, Brucella spp.
LASEGYKPFCAIYSTFLQRGYDQVVHD

SEQ ID NO: 18505 - protein, 22 aa, Brucella spp.
QNLPVRFPIDRAGLVGADGPTH

SEQ ID NO: 18506 - protein, 26 aa, Brucella spp.
HAGSFDTGFLAALPGFVVMAASDEAE

SEQ ID NO: 18507 - protein, 19 aa, Brucella spp.
GPISFRYPRGDGVGVDLPE

SEQ ID NO: 18508 - protein, 17 aa, Brucella spp.
YPRGDGVGVDLPERGSV

SEQ ID NO: 18509 - protein, 17 aa, Brucella spp.
RGDGVGVDLPERGSVLE

SEQ ID NO: 18510 - protein, 20 aa, Brucella spp.
EGTKVALLSFGTRLQECLAA

SEQ ID NO: 18511 - protein, 20 aa, Brucella spp.
AKPLDHDLIRRLAREHEVLV

SEQ ID NO: 18512 - protein, 17 aa, Brucella spp.
HDLIRRLAREHEVLVMV

SEQ ID NO: 18513 - protein, 18 aa, Brucella spp.
EGAVGGFGSHVLQFLATD

SEQ ID NO: 18514 - protein, 17 aa, Brucella spp.
KVRALTLPDIYQDHGKP

SEQ ID NO: 18515 - protein, 29 aa, Brucella spp.
LPTARRRLVGPFIFFDRMGPAILRDGEAL

SEQ ID NO: 18516 - protein, 21 aa, Brucella spp.
RAGPMPVSGVQTWLALPDAME

SEQ ID NO: 18517 - protein, 17 aa, Brucella spp.
VSGVQTWLALPDAMEEI

SEQ ID NO: 18518 - protein, 22 aa, Brucella spp.
LPLMDDAAFSGRLIIGSLHGLS

SEQ ID NO: 18519 - protein, 26 aa, Brucella spp.
IGGEVFPPDRLLAFRPGDDIVVQAGP

SEQ ID NO: 18520 - protein, 17 aa, Brucella spp.
LGSRRYIWWNFVASSKE

SEQ ID NO: 18521 - protein, 25 aa, Brucella spp.
SLAKPVMIALGALLIGKLLKGNSDD

SEQ ID NO: 18522 - protein, 21 aa, Brucella spp.
GGGLGGLLYQLKQSGLGDKVD

SEQ ID NO: 18523 - protein, 21 aa, Brucella spp.
RKLILRYGYLVKLTPERLNQF

SEQ ID NO: 18524 - protein, 23 aa, Brucella spp.
VGAAGWTLIWGLGPYLLSGVLAP

SEQ ID NO: 18525 - protein, 24 aa, Brucella spp.
ERGDVPLEESIRIYERGEALKKHC

SEQ ID NO: 18526 - protein, 18 aa, Brucella spp.
LMSELEGPDFYRLDRVEA

SEQ ID NO: 18527 - protein, 19 aa, Brucella spp.
ELEGPDFYRLDRVEAPHAG

SEQ ID NO: 18528 - protein, 17 aa, Brucella spp.
HAGEAAILLAHPEEHLE

SEQ ID NO: 18529 - protein, 23 aa, Brucella spp.
RSRAMGFCVFNNIAIAARHAQRH

SEQ ID NO: 18530 - protein, 17 aa, Brucella spp.
HGLERIAIVDWDVHHGN

SEQ ID NO: 18531 - protein, 18 aa, Brucella spp.
LERIAIVDWDVHHGNGTQ

SEQ ID NO: 18532 - protein, 17 aa, Brucella spp.
STHQFPLYPGSGDKHET

SEQ ID NO: 18533 - protein, 26 aa, Brucella spp.
REAFNSRILPALDNFRPDLILISAGF

SEQ ID NO: 18534 - protein, 25 aa, Brucella spp.
NFRPDLILISAGFDAHFRDPLAEIN

SEQ ID NO: 18535 - protein, 18 aa, Brucella spp.
AGFDAHFRDPLAEINLDE

SEQ ID NO: 18536 - protein, 18 aa, Brucella spp.
ESHGLALGCVVDGCPPGI

SEQ ID NO: 18537 - protein, 18 aa, Brucella spp.
EAEIQSFLDKRKPGQSKY

SEQ ID NO: 18538 - protein, 19 aa, Brucella spp.
GHADYAYDVKYGIRDYRGG

SEQ ID NO: 18539 - protein, 23 aa, Brucella spp.
WNWAEVDNNPFFTPDAGSVEVFA

SEQ ID NO: 18540 - protein, 17 aa, Brucella spp.
VEIGNGFEAARLTGEEN

SEQ ID NO: 18541 - protein, 25 aa, Brucella spp.
AVPIGEAMVACAIADHYLRHRGQTG

SEQ ID NO: 18542 - protein, 19 aa, Brucella spp.
YKLPGEFDIGAINPGMKVL

SEQ ID NO: 18543 - protein, 24 aa, Brucella spp.
INPGMKVLIIYDIVDHTRFITDIQ

SEQ ID NO: 18544 - protein, 20 aa, Brucella spp.
FNKVTLFKPNLSRMEAKSAV

SEQ ID NO: 18545 - protein, 23 aa, Brucella spp.
DVEGKPVFQGFAGGQGFGGAHGD

SEQ ID NO: 18546 - protein, 20 aa, Brucella spp.
GGAHGDPFAGFRQGGGNSHF

SEQ ID NO: 18547 - protein, 17 aa, Brucella spp.
NSHFEFRGGPGGFQGGG

SEQ ID NO: 18548 - protein, 17 aa, Brucella spp.
RGGPGGFQGGGFGGAED

SEQ ID NO: 18549 - protein, 19 aa, Brucella spp.
NGKHLKIKLPKFVEDGQTI

SEQ ID NO: 18550 - protein, 18 aa, Brucella spp.
ALVTIRFKPHSRFRLEGR

SEQ ID NO: 18551 - protein, 17 aa, Brucella spp.
VDLPVSIDDAVLGGKQE

SEQ ID NO: 18552 - protein, 22 aa, Brucella spp.
LDGRISVKIPAWSSSDRVLRLK

SEQ ID NO: 18553 - protein, 24 aa, Brucella spp.
QSAEPFKLFAEWLADAAKSEPNDP

SEQ ID NO: 18554 - protein, 19 aa, Brucella spp.
DFDETGFVFYTNYESKKGQ

SEQ ID NO: 18555 - protein, 35 aa, Brucella spp.
IGDIPRPPYWSGFRIRPVSIEFWHDRPFRLHDRVL

SEQ ID NO: 18556 - protein, 18 aa, Brucella spp.
WHDRPFRLHDRVLFTRPT

SEQ ID NO: 18557 - protein, 29 aa, Brucella spp.
GGREHALAWKLAASPLLEKLYCALGNPGI

SEQ ID NO: 18558 - protein, 17 aa, Brucella spp.
GVDDHAALIAFAKEKHI

SEQ ID NO: 18559 - protein, 17 aa, Brucella spp.
DDHAALIAFAKEKHIDL

SEQ ID NO: 18560 - protein, 18 aa, Brucella spp.
HAALIAFAKEKHIDLVVV

SEQ ID NO: 18561 - protein, 17 aa, Brucella spp.
APLVAGLADEMRAEGIR

SEQ ID NO: 18562 - protein, 24 aa, Brucella spp.
KDLCARFNIPTGAYGRFNNAPKAK

SEQ ID NO: 18563 - protein, 20 aa, Brucella spp.
IGAPFSGILFAGLMITSDGP

SEQ ID NO: 18564 - protein, 20 aa, Brucella spp.
DEVSLEWKDEPALTVVMAAE

SEQ ID NO: 18565 - protein, 17 aa, Brucella spp.
WKDEPALTVVMAAEGYP

SEQ ID NO: 18566 - protein, 17 aa, Brucella spp.
DEPALTVVMAAEGYPAN

SEQ ID NO: 18567 - protein, 23 aa, Brucella spp.
EKLESIDGVKLFHAGTALKDGAI

SEQ ID NO: 18568 - protein, 29 aa, Brucella spp.
QARAYEALKLIDWPEGFYRSDIGWRAVER

SEQ ID NO: 18569 - protein, 17 aa, Brucella spp.
FGSEILDFLIPLAETKK

SEQ ID NO: 18570 - protein, 19 aa, Brucella spp.
MGHQKAFALLALGHGFTAE

SEQ ID NO: 18571 - protein, 18 aa, Brucella spp.
EAAQEAGIVYQIVDEEAL

SEQ ID NO: 18572 - protein, 17 aa, Brucella spp.
AGIVYQIVDEEALEAEV

SEQ ID NO: 18573 - protein, 24 aa, Brucella spp.
TEELPVPGIRRFVMGAYLIDYEIR

SEQ ID NO: 18574 - protein, 24 aa, Brucella spp.
YEIRADAILIFAIRHGRERPPILP

SEQ ID NO: 18575 - protein, 20 aa, Brucella spp.
DESGAAIILSLGRMNRIRNL

SEQ ID NO: 18576 - protein, 22 aa, Brucella spp.
PLESPHDWYVLIDISSSRSEED

SEQ ID NO: 18577 - protein, 24 aa, Brucella spp.
AQSFWKMREEMSWAQKPEGGSIKH

SEQ ID NO: 18578 - protein, 23 aa, Brucella spp.
DISVPVASIPAFIHEANAATLDM

SEQ ID NO: 18579 - protein, 17 aa, Brucella spp.
LMRRIKAAFDPAGIMNP

SEQ ID NO: 18580 - protein, 17 aa, Brucella spp.
RRIKAAFDPAGIMNPGK

SEQ ID NO: 18581 - protein, 21 aa, Brucella spp.
PEQAIQGFLRKAGLSDVSQAH

SEQ ID NO: 18582 - protein, 25 aa, Brucella spp.
IRNFPWPKSMRWGVASARPGALRWV

SEQ ID NO: 18583 - protein, 26 aa, Brucella spp.
WGVASARPGALRWVRPLQSILCTFGP

SEQ ID NO: 18584 - protein, 31 aa, Brucella spp.
LLEEVSGLVEWPVVLMGEFEEEFLAIPPEVI

SEQ ID NO: 18585 - protein, 23 aa, Brucella spp.
VVRARLSDALYFWHTDQHDLPDL

SEQ ID NO: 18586 - protein, 23 aa, Brucella spp.
LADKLDTLVGFWAIDEKPTGSKD

SEQ ID NO: 18587 - protein, 31 aa, Brucella spp.
GVIRLLLSQEWKFPLLPLFRSAFAALQEGQM

SEQ ID NO: 18588 - protein, 24 aa, Brucella spp.
ASCGPVLADLLSFFHDRFKVHLKE

SEQ ID NO: 18589 - protein, 19 aa, Brucella spp.
EADNLLLVARRLEALIVFI

SEQ ID NO: 18590 - protein, 24 aa, Brucella spp.
LLVARRLEALIVFINEVDGKNLLA

SEQ ID NO: 18591 - protein, 22 aa, Brucella spp.
RGCEHGCIYCFARPTHSYMGLS

SEQ ID NO: 18592 - protein, 24 aa, Brucella spp.
THSYMGLSAGLDFETRLFAKPDAP

SEQ ID NO: 18593 - protein, 29 aa, Brucella spp.
AGYVLLPLEVAPLFKDWLLRNYPDRYRHV

SEQ ID NO: 18594 - protein, 18 aa, Brucella spp.
RYRHVMSLVRSMRDGKDY

SEQ ID NO: 18595 - protein, 18 aa, Brucella spp.
TGPYAWQIGRRFEIAARK

SEQ ID NO: 18596 - protein, 18 aa, Brucella spp.
WQIGRRFEIAARKLGFNT

SEQ ID NO: 18597 - protein, 23 aa, Brucella spp.
PLLFDLPLAPDFSQEQQLMKRGL

SEQ ID NO: 18598 - protein, 19 aa, Brucella spp.
EALYEIILTKAITVSVASL

SEQ ID NO: 18599 - protein, 17 aa, Brucella spp.
VPGLHRYTFAPIKGRFD

SEQ ID NO: 18600 - protein, 18 aa, Brucella spp.
IALVIFVAIVVYMKVPGM

SEQ ID NO: 18601 - protein, 20 aa, Brucella spp.
VVYMKVPGMIGRTLDERADR

SEQ ID NO: 18602 - protein, 18 aa, Brucella spp.
RIKKELEEARTLREEAQQ

SEQ ID NO: 18603 - protein, 18 aa, Brucella spp.
SGVFPPFDSTHYASQVLW

SEQ ID NO: 18604 - protein, 34 aa, Brucella spp.
THYASQVLWLAITFGLFYLFLSRVVLPRIGGVIE

SEQ ID NO: 18605 - protein, 17 aa, Brucella spp.
FLSRVVLPRIGGVIETR

SEQ ID NO: 18606 - protein, 25 aa, Brucella spp.
GMKFFPFVFSLFMFVLVANFIGLFP

SEQ ID NO: 18607 - protein, 24 aa, Brucella spp.
GFFKHGFGFLKLFVPSGVPGIIVP

SEQ ID NO: 18608 - protein, 24 aa, Brucella spp.
PHKQHWLVPFVLAASAYLFNSNAI

SEQ ID NO: 18609 - protein, 20 aa, Brucella spp.
LGTHRWTAFIARAPVGSVHQ

SEQ ID NO: 18610 - protein, 23 aa, Brucella spp.
HQAEMPFVDAITVTGSIATNGIE

SEQ ID NO: 18611 - protein, 24 aa, Brucella spp.
LEGKEIGITMAFHRVKPPKPKAEL

SEQ ID NO: 18612 - protein, 25 aa, Brucella spp.
YQNRDWLNACQFSFACDGQKHRVTE

SEQ ID NO: 18613 - protein, 20 aa, Brucella spp.
HATYVRPFWAPTMKKLTKIG

SEQ ID NO: 18614 - protein, 21 aa, Brucella spp.
GSEAGMYDAFQLGLGEPCPIS

SEQ ID NO: 18615 - protein, 20 aa, Brucella spp.
SISADWEWHGRKIKLFDTAG

SEQ ID NO: 18616 - protein, 25 aa, Brucella spp.
LRAIRFAEVVIIVLDATIPFEKQDL

SEQ ID NO: 18617 - protein, 21 aa, Brucella spp.
REGRAPVIAFNKWDLIEDRQM

SEQ ID NO: 18618 - protein, 19 aa, Brucella spp.
ISTGRLNRWLEGVIAHQPP

SEQ ID NO: 18619 - protein, 25 aa, Brucella spp.
ETFDMPGVPIRLSLRTSDNPFAGRA

SEQ ID NO: 18620 - protein, 17 aa, Brucella spp.
KQVWRNFGPALIGAAVA

SEQ ID NO: 18621 - protein, 18 aa, Brucella spp.
YPVLARLRAASVLADKGD

SEQ ID NO: 18622 - protein, 24 aa, Brucella spp.
SRNIARLRAGYLLVDNGSYDDVAE

SEQ ID NO: 18623 - protein, 24 aa, Brucella spp.
TSAREALGLAAWKAERFDDAAKLF

SEQ ID NO: 18624 - protein, 19 aa, Brucella spp.
AAKLFKLVAEDSLAPANAR

SEQ ID NO: 18625 - protein, 24 aa, Brucella spp.
SLMACVAGSLAWLICEELLGQPKP

SEQ ID NO: 18626 - protein, 17 aa, Brucella spp.
VLVGAGVGLLFSQILLT

SEQ ID NO: 18627 - protein, 23 aa, Brucella spp.
RRGIRLYAAALLFGEALGNALRK

SEQ ID NO: 18628 - protein, 19 aa, Brucella spp.
ETEPPAWLMESLQIVIANC

SEQ ID NO: 18629 - protein, 29 aa, Brucella spp.
HRIPPIPKDLPFGWRECVLRLEGVQDTLL

SEQ ID NO: 18630 - protein, 17 aa, Brucella spp.
VTIVEYFDYQCPYCKKS

SEQ ID NO: 18631 - protein, 23 aa, Brucella spp.
GNVRLVMKDWIIFGETSAYAARL

SEQ ID NO: 18632 - protein, 26 aa, Brucella spp.
KQGEAFNFAGTPSFVIGTRLYGGVMK

SEQ ID NO: 18633 - protein, 26 aa, Brucella spp.
ARLFGGDLAWFVFWGYQLFIVMAATG

SEQ ID NO: 18634 - protein, 24 aa, Brucella spp.
AEPEWYVDIWLTIVWVAYLVVFMG

SEQ ID NO: 18635 - protein, 22 aa, Brucella spp.
SIVHFWSIIFLYIWAGPHHLHY

SEQ ID NO: 18636 - protein, 17 aa, Brucella spp.
IIFLYIWAGPHHLHYTA

SEQ ID NO: 18637 - protein, 20 aa, Brucella spp.
TVLAMFPYYVIRTIGGVFYL

SEQ ID NO: 18638 - protein, 18 aa, Brucella spp.
PYYVIRTIGGVFYLTGGL

SEQ ID NO: 18639 - protein, 24 aa, Brucella spp.
VGGLVEIAPLFYLENTIEKVEGMR

SEQ ID NO: 18640 - protein, 23 aa, Brucella spp.
VVPESVMPSYAFLKERPLKADDI

SEQ ID NO: 18641 - protein, 21 aa, Brucella spp.
SEMDALIAYLQMLGTLVDFST

SEQ ID NO: 18642 - protein, 36 aa, Brucella spp.
ELDNPMPRWWLWTFYATIFWAIAYVIAYPAWPLISG

SEQ ID NO: 18643 - protein, 19 aa, Brucella spp.
HGVMPAWEARLGDATVKQL

SEQ ID NO: 18644 - protein, 17 aa, Brucella spp.
RVQGTFRRFKWIVMFIT

SEQ ID NO: 18645 - protein, 23 aa, Brucella spp.
TFRRFKWIVMFITLGIYYLTPWL

SEQ ID NO: 18646 - protein, 18 aa, Brucella spp.
NRRFYFFFIEIWPQEFYY

SEQ ID NO: 18647 - protein, 26 aa, Brucella spp.
IEIWPQEFYYVAGLLIMAGLGLFLVT

SEQ ID NO: 18648 - protein, 24 aa, Brucella spp.
RLAKHSIWIVIGVLTGGAWIFYFA

SEQ ID NO: 18649 - protein, 19 aa, Brucella spp.
VLTGGAWIFYFADAPTLLK

SEQ ID NO: 18650 - protein, 18 aa, Brucella spp.
GAWIFYFADAPTLLKDFV

SEQ ID NO: 18651 - protein, 20 aa, Brucella spp.
CTYMCPWPRIQAAMLDENSL

SEQ ID NO: 18652 - protein, 25 aa, Brucella spp.
VLRPRSMFYFAIWALIGVVLIVSLS

SEQ ID NO: 18653 - protein, 25 aa, Brucella spp.
TGWHMLGIMFMFFGVIIAVNLLMAY

SEQ ID NO: 18654 - protein, 18 aa, Brucella spp.
LELGEGAWIMEVNADAGL

SEQ ID NO: 18655 - protein, 20 aa, Brucella spp.
VPDGAGLAASRRLFNAVSGL

SEQ ID NO: 18656 - protein, 24 aa, Brucella spp.
LAAAAHPAKVFSLVVSDIPGDNPA

SEQ ID NO: 18657 - protein, 20 aa, Brucella spp.
SRDEALKIIERYRLDLPQAA

SEQ ID NO: 18658 - protein, 19 aa, Brucella spp.
LKIIERYRLDLPQAALAHI

SEQ ID NO: 18659 - protein, 20 aa, Brucella spp.
ERDRPFKKPVVILSGGETTV

SEQ ID NO: 18660 - protein, 27 aa, Brucella spp.
KGGRNSEFLLSFALDIDGYANIHALAA

SEQ ID NO: 18661 - protein, 20 aa, Brucella spp.
ARLNANDAWTAFDALGDLFV

SEQ ID NO: 18662 - protein, 17 aa, Brucella spp.
ENGRILRLGDYAEVSGE

SEQ ID NO: 18663 - protein, 23 aa, Brucella spp.
ADHRPHLVVPGFIDTHIHYPQTQ

SEQ ID NO: 18664 - protein, 25 aa, Brucella spp.
AANLLEWLNTYTFVAEQKFADEQHA

SEQ ID NO: 18665 - protein, 23 aa, Brucella spp.
QGRLDYVITPRFAITSTPEQLEA

SEQ ID NO: 18666 - protein, 18 aa, Brucella spp.
IAFTRSLYPDAPDYLGIY

SEQ ID NO: 18667 - protein, 17 aa, Brucella spp.
PDYLGIYEHYSLLGNKT

SEQ ID NO: 18668 - protein, 17 aa, Brucella spp.
TSNLFLGSGLFDRDRLK

SEQ ID NO: 18669 - protein, 21 aa, Brucella spp.
VATDIGGGTSFSMLRTMDEGY

SEQ ID NO: 18670 - protein, 18 aa, Brucella spp.
LNPFQSFYMMTLGNARAL

SEQ ID NO: 18671 - protein, 17 aa, Brucella spp.
LEQELFLLQTLGDDRAI

SEQ ID NO: 18672 - protein, 21 aa, Brucella spp.
VEFHGQPIFAVIAKTRDQARR

SEQ ID NO: 18673 - protein, 23 aa, Brucella spp.
EYEEAPGIYSIDMLDGLKDRLVT

SEQ ID NO: 18674 - protein, 20 aa, Brucella spp.
LKDRLVTPPLTLERGNARAA

SEQ ID NO: 18675 - protein, 19 aa, Brucella spp.
KRHGFVIDYEVGFDDDGTI

SEQ ID NO: 18676 - protein, 24 aa, Brucella spp.
GTILGVDYLYALNAGFSADLSGPV

SEQ ID NO: 18677 - protein, 24 aa, Brucella spp.
GIALTPVKFGISFTKTESNQAGAL

SEQ ID NO: 18678 - protein, 19 aa, Brucella spp.
ARQIKKRLIRFAAQQYQVP

SEQ ID NO: 18679 - protein, 22 aa, Brucella spp.
QVPEDQIMFLPNRVRVGNQEIS

SEQ ID NO: 18680 - protein, 20 aa, Brucella spp.
KGRGHAFYYYAYGAACSEVS

SEQ ID NO: 18681 - protein, 24 aa, Brucella spp.
GQIEGGFVQGMGWLTTEELVWDEK

SEQ ID NO: 18682 - protein, 19 aa, Brucella spp.
LTTEELVWDEKGRLRTHAP

SEQ ID NO: 18683 - protein, 28 aa, Brucella spp.
KAVGEPPLPLGLSVLHALADAVASMADY

SEQ ID NO: 18684 - protein, 17 aa, Brucella spp.
YKVCPRLDAPATPERVL

SEQ ID NO: 18685 - protein, 27 aa, Brucella spp.
TSFLPFWEKTRLWVIARPLSGFAETFS

SEQ ID NO: 18686 - protein, 24 aa, Brucella spp.
VVTFEPGGVIPFAETHVMEHGLYV

SEQ ID NO: 18687 - protein, 24 aa, Brucella spp.
VEVEAGDFMWLRAFCPQACYAGGP

SEQ ID NO: 18688 - protein, 19 aa, Brucella spp.
PQACYAGGPGKFRYLLYKD

SEQ ID NO: 18689 - protein, 19 aa, Brucella spp.
GPGKFRYLLYKDVNRHMKL

SEQ ID NO: 18690 - protein, 17 aa, Brucella spp.
DNHPLVLDGLRAVLETY

SEQ ID NO: 18691 - protein, 21 aa, Brucella spp.
MPLLNGIDAIELFKRQLPNVR

SEQ ID NO: 18692 - protein, 18 aa, Brucella spp.
DAIELFKRQLPNVRILML

SEQ ID NO: 18693 - protein, 19 aa, Brucella spp.
RQLPNVRILMLSMHDSREY

SEQ ID NO: 18694 - protein, 17 aa, Brucella spp.
LAPFLSIIRDLEVYERF

SEQ ID NO: 18695 - protein, 19 aa, Brucella spp.
ERFEKVILVHGVRQVAELA

SEQ ID NO: 18696 - protein, 18 aa, Brucella spp.
RQVAELAYTDFISNELPQ

SEQ ID NO: 18697 - protein, 20 aa, Brucella spp.
MESTLAVTLDMMIMHGQAVM

SEQ ID NO: 18698 - protein, 32 aa, Brucella spp.
EEMAETVAFLVRRGIPVFGHVGLMPQQVNTVG

SEQ ID NO: 18699 - protein, 17 aa, Brucella spp.
PLAREITALIDIPTVGI

SEQ ID NO: 18700 - protein, 17 aa, Brucella spp.
ITALIDIPTVGIGASSA

SEQ ID NO: 18701 - protein, 17 aa, Brucella spp.
KKIGFVPTMGYLHKGHL

SEQ ID NO: 18702 - protein, 23 aa, Brucella spp.
MVDDMAIPVRIVGVETVREDDGL

SEQ ID NO: 18703 - protein, 17 aa, Brucella spp.
LAVPEVIAIRDPETLER

SEQ ID NO: 18704 - protein, 29 aa, Brucella spp.
ERLPALQGRPILVALFVRVGATRLLDNRV

SEQ ID NO: 18705 - protein, 21 aa, Brucella spp.
VYRRFPLWWLTPLAVTPLLLM

SEQ ID NO: 18706 - protein, 18 aa, Brucella spp.
RRYWPVLLAGVLVGSSAA

SEQ ID NO: 18707 - protein, 24 aa, Brucella spp.
GAEWFLAEMLLFFIPAVLAILEHR

SEQ ID NO: 18708 - protein, 20 aa, Brucella spp.
AELGELRGLKRGLLRLGLPP

SEQ ID NO: 18709 - protein, 24 aa, Brucella spp.
AASLLPVEESFAWQDVRCEPVVAL

SEQ ID NO: 18710 - protein, 24 aa, Brucella spp.
TLREIANLPFILFESGFALNHIIL

SEQ ID NO: 18711 - protein, 23 aa, Brucella spp.
DADVNWRMAFVWRKGAFLSHAAR

SEQ ID NO: 18712 - protein, 22 aa, Brucella spp.
KGAFLSHAARAWLALCEGTFTP

SEQ ID NO: 18713 - protein, 23 aa, Brucella spp.
DHLEPGGFIRFTFRDDREHGREV

SEQ ID NO: 18714 - protein, 24 aa, Brucella spp.
VRIIIPNPIGLGMVAQFVSYDAAQ

SEQ ID NO: 18715 - protein, 21 aa, Brucella spp.
HAEKRYRVFADLERIVGRFPQ

SEQ ID NO: 18716 - protein, 22 aa, Brucella spp.
LERIVGRFPQAIWRNNGTAREI

SEQ ID NO: 18717 - protein, 21 aa, Brucella spp.
HGKEAGLVFTSGFVSNEASIS

SEQ ID NO: 18718 - protein, 19 aa, Brucella spp.
RLLPNCLILSDELNHASMI

SEQ ID NO: 18719 - protein, 19 aa, Brucella spp.
SRAKLIVFESVYSMDGDIA

SEQ ID NO: 18720 - protein, 24 aa, Brucella spp.
IDIIEGTLAKAFGALGGYITGSRA

SEQ ID NO: 18721 - protein, 23 aa, Brucella spp.
DAVRSYAPGFIFTTSLPPAVAAA

SEQ ID NO: 18722 - protein, 22 aa, Brucella spp.
AKDVLSAAGLPVMPSQTHIVPI

SEQ ID NO: 18723 - protein, 25 aa, Brucella spp.
KDALLEVWNELGIPFAEPSAPQAAN

SEQ ID NO: 18724 - protein, 17 aa, Brucella spp.
LAIGVIIGGAFGGLVNS

SEQ ID NO: 18725 - protein, 23 aa, Brucella spp.
LINFLIIAWVLFLVVKLMNRLKK

SEQ ID NO: 18726 - protein, 25 aa, Brucella spp.
ERVSELVLRGIFMVRRFEVDWMYSN

SEQ ID NO: 18727 - protein, 18 aa, Brucella spp.
RWARWEGSVISLLPDPAR

SEQ ID NO: 18728 - protein, 17 aa, Brucella spp.
WEGSVISLLPDPARVDA

SEQ ID NO: 18729 - protein, 17 aa, Brucella spp.
DQYAIAFARIECHYFQN

SEQ ID NO: 18730 - protein, 19 aa, Brucella spp.
IRHIPGVIVHGRYDICTPF

SEQ ID NO: 18731 - protein, 17 aa, Brucella spp.
VIVHGRYDICTPFINAW

SEQ ID NO: 18732 - protein, 18 aa, Brucella spp.
YDICTPFINAWQLKKMWP

SEQ ID NO: 18733 - protein, 19 aa, Brucella spp.
TPFINAWQLKKMWPEADLK

SEQ ID NO: 18734 - protein, 34 aa, Brucella spp.
QALKYEVSRGGALFPHLYAPLPLTAVVKVEPLPL

SEQ ID NO: 18735 - protein, 20 aa, Brucella spp.
KIGHSVGWGNGFVSRLKQAG

SEQ ID NO: 18736 - protein, 23 aa, Brucella spp.
LETGCVYIVPLLESLALSPELSA

SEQ ID NO: 18737 - protein, 19 aa, Brucella spp.
VLDPDEFYILVSREAVHVP

SEQ ID NO: 18738 - protein, 20 aa, Brucella spp.
EAVHVPPLYAAEMTPFDPLV

SEQ ID NO: 18739 - protein, 18 aa, Brucella spp.
LYAAEMTPFDPLVGEFRV

SEQ ID NO: 18740 - protein, 18 aa, Brucella spp.
MTPFDPLVGEFRVHYAGF

SEQ ID NO: 18741 - protein, 25 aa, Brucella spp.
LVGEFRVHYAGFFDPGFGHSAAGGT

SEQ ID NO: 18742 - protein, 25 aa, Brucella spp.
QSEPEENRYVWGYRVTIVNNSSETV

SEQ ID NO: 18743 - protein, 21 aa, Brucella spp.
MKGEDGAQFEIEIPAFSLDVP

SEQ ID NO: 18744 - protein, 19 aa, Brucella spp.
RLLAEATVLTVLLGTSLKF

SEQ ID NO: 18745 - protein, 20 aa, Brucella spp.
EATVLTVLLGTSLKFDGKFI

SEQ ID NO: 18746 - protein, 24 aa, Brucella spp.
LGTSLKFDGKFIFQTQSDGPVDML

SEQ ID NO: 18747 - protein, 23 aa, Brucella spp.
RPEELLGNGTLAFTVDQGIYTQR

SEQ ID NO: 18748 - protein, 20 aa, Brucella spp.
PTDLKLSVAKLIERGADGKP

SEQ ID NO: 18749 - protein, 17 aa, Brucella spp.
LSVAKLIERGADGKPVE

SEQ ID NO: 18750 - protein, 27 aa, Brucella spp.
KPVEQWRAGGLIIQFLPESELRVRVPD

SEQ ID NO: 18751 - protein, 20 aa, Brucella spp.
LFHERGVRVFDSIAVIDECS

SEQ ID NO: 18752 - protein, 21 aa, Brucella spp.
VERPYAGKVLAMIFEKLSTRT

SEQ ID NO: 18753 - protein, 22 aa, Brucella spp.
SLVEAAARFDFNVNIATPKGSE

SEQ ID NO: 18754 - protein, 21 aa, Brucella spp.
RGHNVFIPYQVNANLMAKADP

SEQ ID NO: 18755 - protein, 23 aa, Brucella spp.
SGHPERFRIITFEGAFHGRTLAT

SEQ ID NO: 18756 - protein, 25 aa, Brucella spp.
GGLRAFPEEFLRLVRQICDENGLLL

SEQ ID NO: 18757 - protein, 20 aa, Brucella spp.
TGKLFAHEWAGIRPDIMAIA

SEQ ID NO: 18758 - protein, 21 aa, Brucella spp.
KGIGGGFPIGACLATAEAAKG

SEQ ID NO: 18759 - protein, 17 aa, Brucella spp.
AVLDVVLADGFMENVQA

SEQ ID NO: 18760 - protein, 17 aa, Brucella spp.
PNEAAYVFLGIMLAVLS

SEQ ID NO: 18761 - protein, 17 aa, Brucella spp.
AAYVFLGIMLAVLSVPA

SEQ ID NO: 18762 - protein, 20 aa, Brucella spp.
LEQSIVAALELFATDERQQV

SEQ ID NO: 18763 - protein, 20 aa, Brucella spp.
MRSNVLALFIGLLKVAERRG

SEQ ID NO: 18764 - protein, 20 aa, Brucella spp.
ETAAQILLAMVGGFLNEWLH

SEQ ID NO: 18765 - protein, 27 aa, Brucella spp.
MPNILQYPITFTAVLRAGFVVVNVNPL

SEQ ID NO: 18766 - protein, 28 aa, Brucella spp.
RVKKMVPAWNIPGHVRFKDALAQGRAKS

SEQ ID NO: 18767 - protein, 29 aa, Brucella spp.
KPKALNFVCALPLYHIFALTVNAMIGMKL

SEQ ID NO: 18768 - protein, 21 aa, Brucella spp.
LKKYPVHIFPGLNTLFNGLIN

SEQ ID NO: 18769 - protein, 24 aa, Brucella spp.
LDATEFTGTIGLPMPSTDVVIRDD

SEQ ID NO: 18770 - protein, 18 aa, Brucella spp.
ETARAIMADGFFRTGDMG

SEQ ID NO: 18771 - protein, 18 aa, Brucella spp.
IMADGFFRTGDMGFMDER

SEQ ID NO: 18772 - protein, 20 aa, Brucella spp.
KDMILVSGFNVYPNEIEEVA

SEQ ID NO: 18773 - protein, 17 aa, Brucella spp.
HSGEVVKLYVVRRDPEL

SEQ ID NO: 18774 - protein, 24 aa, Brucella spp.
LIDFDRTWFSISWQLAQWSAQGDE

SEQ ID NO: 18775 - protein, 26 aa, Brucella spp.
VLARALLDAGGYDWLAERFRANSVIA

SEQ ID NO: 18776 - protein, 19 aa, Brucella spp.
LGIDHLFDVMIGYDTAARP

SEQ ID NO: 18777 - protein, 22 aa, Brucella spp.
PKPFPDPLLYFAEKLGLSPHEI

SEQ ID NO: 18778 - protein, 26 aa, Brucella spp.
HGAELPGQAALHFLIPMLKQAAEEGR

SEQ ID NO: 18779 - protein, 34 aa, Brucella spp.
HLGRFETFSLINFNRAFPLLPDFDTSDLPGPDAP

SEQ ID NO: 18780 - protein, 23 aa, Brucella spp.
RGDAEGLYRFLVHRGVVRDENVK

SEQ ID NO: 18781 - protein, 23 aa, Brucella spp.
RYSLCLDDLLFDWSKCRVNDETM

SEQ ID NO: 18782 - protein, 17 aa, Brucella spp.
ASTLIIVASKTFTTIET

SEQ ID NO: 18783 - protein, 32 aa, Brucella spp.
KVAAFGIPEDRVFGFWDWVGGRYSVWSAIGLP

SEQ ID NO: 18784 - protein, 28 aa, Brucella spp.
GRYSVWSAIGLPVMIAVGPDNFRKFLAG

SEQ ID NO: 18785 - protein, 29 aa, Brucella spp.
APLEKNLPVMLGLIGYWHRAICGYGSRAI

SEQ ID NO: 18786 - protein, 23 aa, Brucella spp.
HRAICGYGSRAIIPYDQRLSRLP

SEQ ID NO: 18787 - protein, 19 aa, Brucella spp.
DTIPLEFIVAAKGHEPTLD

SEQ ID NO: 18788 - protein, 21 aa, Brucella spp.
LDPYTLGRLIALYEHRVFVEA

SEQ ID NO: 18789 - protein, 18 aa, Brucella spp.
ARLPAGDYAHVFDDLHPP

SEQ ID NO: 18790 - protein, 26 aa, Brucella spp.
MNACPTGIDIPLFIRQINAGNPAGAA

SEQ ID NO: 18791 - protein, 24 aa, Brucella spp.
FAQRELDFVLQIGGIHIEYNQTLG

SEQ ID NO: 18792 - protein, 24 aa, Brucella spp.
VEALKAGYDAVFLAMGLPGVNDLG

SEQ ID NO: 18793 - protein, 20 aa, Brucella spp.
STLPVGRDIVVIGGGMTAID

SEQ ID NO: 18794 - protein, 29 aa, Brucella spp.
YEQELAQIHGVVIRHWLQPHALERSEDGI

SEQ ID NO: 18795 - protein, 25 aa, Brucella spp.
ERSEDGIVHAITFEYTANRDGKLVG

SEQ ID NO: 18796 - protein, 27 aa, Brucella spp.
YNVERAFKAGWGGVVWKTLGAEGPPVV

SEQ ID NO: 18797 - protein, 23 aa, Brucella spp.
VKMRWPDRALIASIMVPCEEEAW

SEQ ID NO: 18798 - protein, 23 aa, Brucella spp.
EEEAWKAILPLVEETGADGIELN

SEQ ID NO: 18799 - protein, 18 aa, Brucella spp.
GPAVKPIALNMVAEIARD

SEQ ID NO: 18800 - protein, 19 aa, Brucella spp.
LPISGIGGITTWQDAAEFI

SEQ ID NO: 18801 - protein, 17 aa, Brucella spp.
QVCTAAMTYGFKVVQEM

SEQ ID NO: 18802 - protein, 18 aa, Brucella spp.
AAMTYGFKVVQEMIDGLS

SEQ ID NO: 18803 - protein, 17 aa, Brucella spp.
FAVQVLAIMGPRAEAAN

SEQ ID NO: 18804 - protein, 21 aa, Brucella spp.
LFQNWCEKAGLSMGVDTMGNM

SEQ ID NO: 18805 - protein, 23 aa, Brucella spp.
EGTRFAPAMLASGVFVGVLDQNW

SEQ ID NO: 18806 - protein, 20 aa, Brucella spp.
KTFGEELVRIGWKGDEPVGS

SEQ ID NO: 18807 - protein, 17 aa, Brucella spp.
LVRIGWKGDEPVGSRKI

SEQ ID NO: 18808 - protein, 19 aa, Brucella spp.
HGQGLWWLQVTLTGKEAHT

SEQ ID NO: 18809 - protein, 23 aa, Brucella spp.
RNVLPGQIVFTVDFRSPNQATLD

SEQ ID NO: 18810 - protein, 25 aa, Brucella spp.
PKIAEELGIGIEIEVAGHFDPVTFD

SEQ ID NO: 18811 - protein, 19 aa, Brucella spp.
IEIEVAGHFDPVTFDTGCV

SEQ ID NO: 18812 - protein, 25 aa, Brucella spp.
LPDSEGNLLDALQEWFQKAGKARTD

SEQ ID NO: 18813 - protein, 23 aa, Brucella spp.
ARTDYSFHIAITGWNERTFNEMV

SEQ ID NO: 18814 - protein, 22 aa, Brucella spp.
GINTFKHFMAYKGALMVNDDEM

SEQ ID NO: 18815 - protein, 26 aa, Brucella spp.
GGLEERMPVLWTRGVRTGRLTPNEFV

SEQ ID NO: 18816 - protein, 32 aa, Brucella spp.
HSSIDYNVFEGFELKGLPIMTLSRGRIAFDKG

SEQ ID NO: 18817 - protein, 19 aa, Brucella spp.
LSQWKEIVAPRKVERSAEH

SEQ ID NO: 18818 - protein, 22 aa, Brucella spp.
LCLLIILAATGGWYVYKNNNGA

SEQ ID NO: 18819 - protein, 28 aa, Brucella spp.
IDDRSTVLIDIWVPERFAPQIKVGQPLT

SEQ ID NO: 18820 - protein, 17 aa, Brucella spp.
AEDRLRAGMSFSVTILF

SEQ ID NO: 18821 - protein, 28 aa, Brucella spp.
DRLRAGMSFSVTILFPGDNYPSVDPLAI

SEQ ID NO: 18822 - protein, 35 aa, Brucella spp.
DNYPSVDPLAIQWGADGSYVWRIENGIAKKIPVRI

SEQ ID NO: 18823 - protein, 21 aa, Brucella spp.
RIENGIAKKIPVRIVQRSSDN

SEQ ID NO: 18824 - protein, 17 aa, Brucella spp.
FSKAFSRSKQEHMTEKT

SEQ ID NO: 18825 - protein, 21 aa, Brucella spp.
KNAALPLMIASLLTDDTLTLE

SEQ ID NO: 18826 - protein, 18 aa, Brucella spp.
VEQLIRILSNHGVDYSVN

SEQ ID NO: 18827 - protein, 27 aa, Brucella spp.
YELVSRMRASFWVIGPLLARMGEANVS

SEQ ID NO: 18828 - protein, 17 aa, Brucella spp.
PGGCAIGTRPVDLLLDA

SEQ ID NO: 18829 - protein, 17 aa, Brucella spp.
GCAIGTRPVDLLLDALL

SEQ ID NO: 18830 - protein, 23 aa, Brucella spp.
VDLLLDALLALGAEIDIENGYAK

SEQ ID NO: 18831 - protein, 17 aa, Brucella spp.
LALGAEIDIENGYAKAK

SEQ ID NO: 18832 - protein, 18 aa, Brucella spp.
SQLSCVLETLRQAGAEIN

SEQ ID NO: 18833 - protein, 26 aa, Brucella spp.
DPFPGFPTDLQAQFMGLMTRAKGTSH

SEQ ID NO: 18834 - protein, 17 aa, Brucella spp.
LRASVSLVIAGLAAEGE

SEQ ID NO: 18835 - protein, 21 aa, Brucella spp.
DFEQKFAAFLSGKREVSEDVD

SEQ ID NO: 18836 - protein, 21 aa, Brucella spp.
VELGSRWTAIKAVGLYVPGGT

SEQ ID NO: 18837 - protein, 18 aa, Brucella spp.
NLNPLVLVAARLAGVSEI

SEQ ID NO: 18838 - protein, 20 aa, Brucella spp.
SWRDFGAVILVKDFEDAIPL

SEQ ID NO: 18839 - protein, 23 aa, Brucella spp.
KDFEDAIPLANRIAAEHLEIAVA

SEQ ID NO: 18840 - protein, 19 aa, Brucella spp.
RIRNAGSIFIGGYTPEVIG

SEQ ID NO: 18841 - protein, 17 aa, Brucella spp.
FSSGLSVLDYMKRTSLL

SEQ ID NO: 18842 - protein, 22 aa, Brucella spp.
EALKGHGLTFTIGRGNDICCHA

SEQ ID NO: 18843 - protein, 34 aa, Brucella spp.
NQVWEVDQAIEWVRRLAFANPFFIEEPTSPDDVA

SEQ ID NO: 18844 - protein, 20 aa, Brucella spp.
KYDLPVWPHAGGVGLCEYVQ

SEQ ID NO: 18845 - protein, 17 aa, Brucella spp.
WPHAGGVGLCEYVQHLS

SEQ ID NO: 18846 - protein, 17 aa, Brucella spp.
HAGGVGLCEYVQHLSMI

SEQ ID NO: 18847 - protein, 19 aa, Brucella spp.
AAYMPPSLPGFSIEMKPQS

SEQ ID NO: 18848 - protein, 21 aa, Brucella spp.
AKLEGIAGIVTRRLDVLDDAA

SEQ ID NO: 18849 - protein, 19 aa, Brucella spp.
ALVAEIGQIDILFNCAGFV

SEQ ID NO: 18850 - protein, 21 aa, Brucella spp.
EIGQIDILFNCAGFVHNGTIL

SEQ ID NO: 18851 - protein, 18 aa, Brucella spp.
LFNCAGFVHNGTILEMKD

SEQ ID NO: 18852 - protein, 22 aa, Brucella spp.
DEELDFAVNLNVRSMIRTIRAV

SEQ ID NO: 18853 - protein, 20 aa, Brucella spp.
KGVSNRFVYGLTKAAVIGLT

SEQ ID NO: 18854 - protein, 21 aa, Brucella spp.
LAEKWGVTAFASMQEALAVEG

SEQ ID NO: 18855 - protein, 28 aa, Brucella spp.
ARKLKAAVNFQLRFAPMMLALYDAVDKG

SEQ ID NO: 18856 - protein, 17 aa, Brucella spp.
FAPMMLALYDAVDKGWL

SEQ ID NO: 18857 - protein, 29 aa, Brucella spp.
VDFDAWLALATPWGLWPFLKGLPRIEIAM

SEQ ID NO: 18858 - protein, 17 aa, Brucella spp.
AWFPDAFLNRMAHLQRF

SEQ ID NO: 18859 - protein, 23 aa, Brucella spp.
ADCIEAIWRRLEFATHATTIGAI

SEQ ID NO: 18860 - protein, 18 aa, Brucella spp.
KQNLPLWKLAGGARDHCP

SEQ ID NO: 18861 - protein, 30 aa, Brucella spp.
AHMAEAFDIPVCPHFLMELHVSLVCAVPNG

SEQ ID NO: 18862 - protein, 26 aa, Brucella spp.
VAPSQPGIGIAWDWDAVRSRSIGEFT

SEQ ID NO: 18863 - protein, 17 aa, Brucella spp.
NALSYPWLESAPALNRD

SEQ ID NO: 18864 - protein, 18 aa, Brucella spp.
EEPGFAAYLERQLSDPFV

SEQ ID NO: 18865 - protein, 18 aa, Brucella spp.
RQLSDPFVKGLRRVLHVV

SEQ ID NO: 18866 - protein, 18 aa, Brucella spp.
EVSEGALFRENIKRLEGT

SEQ ID NO: 18867 - protein, 23 aa, Brucella spp.
APDIKAGALDGWREGMAEISRRP

SEQ ID NO: 18868 - protein, 21 aa, Brucella spp.
AESWTVETLRPYAEQVIQSFG

SEQ ID NO: 18869 - protein, 24 aa, Brucella spp.
PYAEQVIQSFGWDRVIWGSDWPVC

SEQ ID NO: 18870 - protein, 20 aa, Brucella spp.
DGSRKSFIAWRCRYDDTRGP

SEQ ID NO: 18871 - protein, 33 aa, Brucella spp.
VEEVETPAFWMTFKCAVMNLPYGGGKGAIQVDP

SEQ ID NO: 18872 - protein, 22 aa, Brucella spp.
ELERLSRAYIQAFSGIIGPDRD

SEQ ID NO: 18873 - protein, 20 aa, Brucella spp.
PDVYTNSMIMGWMADEYSQI

SEQ ID NO: 18874 - protein, 24 aa, Brucella spp.
LSHDLGLASVLRVAIQGFGNAGQF

SEQ ID NO: 18875 - protein, 17 aa, Brucella spp.
DGLDVDLLLAAKADGKS

SEQ ID NO: 18876 - protein, 17 aa, Brucella spp.
LDVDLLLAAKADGKSVI

SEQ ID NO: 18877 - protein, 17 aa, Brucella spp.
MVLPDILANAGGVTVSY

SEQ ID NO: 18878 - protein, 25 aa, Brucella spp.
IDIYPEYTGNAAFFFNKADDPLWKD

SEQ ID NO: 18879 - protein, 22 aa, Brucella spp.
ALPAFQTAYGFTLKPDQLITLS

SEQ ID NO: 18880 - protein, 25 aa, Brucella spp.
IEELLKPVFEKLDLTTLQDLNGRVQ

SEQ ID NO: 18881 - protein, 18 aa, Brucella spp.
FRILFTTHPTPMWVYDPE

SEQ ID NO: 18882 - protein, 17 aa, Brucella spp.
FTTHPTPMWVYDPETLR

SEQ ID NO: 18883 - protein, 20 aa, Brucella spp.
YDPETLRFIVMNDAAYELYG

SEQ ID NO: 18884 - protein, 22 aa, Brucella spp.
TADEIPGMTVLDIRPQSERDRM

SEQ ID NO: 18885 - protein, 18 aa, Brucella spp.
IDVLTYGRQVVFDGREAI

SEQ ID NO: 18886 - protein, 24 aa, Brucella spp.
LDIFPEREAAVFAQHDRMVMRRRE

SEQ ID NO: 18887 - protein, 24 aa, Brucella spp.
VEGNEPRYLIGLVEDITERREIEK

SEQ ID NO: 18888 - protein, 20 aa, Brucella spp.
SDCDPFALFYLDIDHFKNVN

SEQ ID NO: 18889 - protein, 20 aa, Brucella spp.
QFQLHYQPIFNLEGGHISGF

SEQ ID NO: 18890 - protein, 21 aa, Brucella spp.
GGHISGFEALIRWNHPEHGMI

SEQ ID NO: 18891 - protein, 24 aa, Brucella spp.
NHPEHGMIPPLEFISVAEETGLIG

SEQ ID NO: 18892 - protein, 21 aa, Brucella spp.
EETGLIGPIGDWVLQEACREA

SEQ ID NO: 18893 - protein, 27 aa, Brucella spp.
REAARWPEDIKVSVNLSPVQFDQSTLL

SEQ ID NO: 18894 - protein, 23 aa, Brucella spp.
SKHNIELLFDLRRLGVRIAMDDF

SEQ ID NO: 18895 - protein, 20 aa, Brucella spp.
LSYLRAFPFDKIKIDRSFVS

SEQ ID NO: 18896 - protein, 18 aa, Brucella spp.
LPLPHCKPLIQLILQDNT

SEQ ID NO: 18897 - protein, 20 aa, Brucella spp.
CSWFAGGMLAPWCEGESAEE

SEQ ID NO: 18898 - protein, 17 aa, Brucella spp.
PVVRLGQDAIGWWERHV

SEQ ID NO: 18899 - protein, 19 aa, Brucella spp.
PDLAGRFRQGLFFADEGHL

SEQ ID NO: 18900 - protein, 26 aa, Brucella spp.
VRLLHPRIPLYIVPRGDGIHMIGATM

SEQ ID NO: 18901 - protein, 20 aa, Brucella spp.
GVDARPAFADNLPRVRRRGD

SEQ ID NO: 18902 - protein, 17 aa, Brucella spp.
FESRLLLGTAQYPSPSI

SEQ ID NO: 18903 - protein, 21 aa, Brucella spp.
EARAGQDFWALIKALGVAVLP

SEQ ID NO: 18904 - protein, 19 aa, Brucella spp.
GFEVFPYMNDDLIVAERLI

SEQ ID NO: 18905 - protein, 24 aa, Brucella spp.
LIEAGCKVLMPWGAPIGSGRGFNN

SEQ ID NO: 18906 - protein, 22 aa, Brucella spp.
HAAAAMELGFDAVLINTAVAKA

SEQ ID NO: 18907 - protein, 21 aa, Brucella spp.
WKPYIEHDFVRGLGDGTLPKA

SEQ ID NO: 18908 - protein, 19 aa, Brucella spp.
GTLPKAAFLHYLRQDYVYL

SEQ ID NO: 18909 - protein, 23 aa, Brucella spp.
YVYLHHYARAFALGVVKANTSQE

SEQ ID NO: 18910 - protein, 17 aa, Brucella spp.
LPLHVRICAREGISEDA

SEQ ID NO: 18911 - protein, 18 aa, Brucella spp.
GQAGDFLDLLTALVPCAH

SEQ ID NO: 18912 - protein, 17 aa, Brucella spp.
KSPRWPKLCQIFATASR

SEQ ID NO: 18913 - protein, 19 aa, Brucella spp.
WPKLCQIFATASRLEADFW

SEQ ID NO: 18914 - protein, 25 aa, Brucella spp.
APHIIHPMRFVLPYHKGGLRPAWLL

SEQ ID NO: 18915 - protein, 29 aa, Brucella spp.
PYHKGGLRPAWLLRLGLFLYDHLGGRKKL

SEQ ID NO: 18916 - protein, 19 aa, Brucella spp.
VHARLLVNAAGPWADKVLQ

SEQ ID NO: 18917 - protein, 23 aa, Brucella spp.
GRIIFAIPYEDDFTLIGTTDQDY

SEQ ID NO: 18918 - protein, 19 aa, Brucella spp.
RREDIVWTYSGVRPLYDDG

SEQ ID NO: 18919 - protein, 23 aa, Brucella spp.
ELKKLEAAYPFLDARRLFRLYGT

SEQ ID NO: 18920 - protein, 19 aa, Brucella spp.
LTAAEVAAVQGFVEPAIAA

SEQ ID NO: 18921 - protein, 17 aa, Brucella spp.
RARLLRRIHGGALYPSG

SEQ ID NO: 18922 - protein, 21 aa, Brucella spp.
IIPDGASLFINIGTTTEAVSH

SEQ ID NO: 18923 - protein, 19 aa, Brucella spp.
PSIEVVIAGGVVRASDGGI

SEQ ID NO: 18924 - protein, 26 aa, Brucella spp.
VDFIRQFKVDFAIIGTSAIDEDGALL

SEQ ID NO: 18925 - protein, 24 aa, Brucella spp.
IDEDGALLDFDFREVKVAQAIIAN

SEQ ID NO: 18926 - protein, 18 aa, Brucella spp.
CIFNGLVMNGLKLAVICR

SEQ ID NO: 18927 - protein, 17 aa, Brucella spp.
LAVICRPFIDHGEVLED

SEQ ID NO: 18928 - protein, 25 aa, Brucella spp.
IIDKWRPVPVVFLAEREEWAQVVRA

SEQ ID NO: 18929 - protein, 18 aa, Brucella spp.
CVEAIHLATAGGMYVPAS

SEQ ID NO: 18930 - protein, 18 aa, Brucella spp.
VVHAIRLGRSNKVIAYEL

SEQ ID NO: 18931 - protein, 30 aa, Brucella spp.
GRLPDHLGRKFLLVDPLDGTREFLLRNGDF

SEQ ID NO: 18932 - protein, 19 aa, Brucella spp.
LDGTREFLLRNGDFTVNIG

SEQ ID NO: 18933 - protein, 21 aa, Brucella spp.
EEGAPVLGIVYAPARNLLFIG

SEQ ID NO: 18934 - protein, 22 aa, Brucella spp.
GIVYAPARNLLFIGSDAGAWAM

SEQ ID NO: 18935 - protein, 19 aa, Brucella spp.
VGSSLKFCILAKGEADIYP

SEQ ID NO: 18936 - protein, 19 aa, Brucella spp.
ADIYPRFGPTMEWDTAAGD

SEQ ID NO: 18937 - protein, 20 aa, Brucella spp.
QEHKSLLRFLTCGSVDDGKS

SEQ ID NO: 18938 - protein, 25 aa, Brucella spp.
EREQGITIDVAYRFFSTPRRKFIVA

SEQ ID NO: 18939 - protein, 24 aa, Brucella spp.
VADYLSFAQDLGFTSIQPIPLSAR

SEQ ID NO: 18940 - protein, 18 aa, Brucella spp.
TSIQPIPLSARFGDNVTA

SEQ ID NO: 18941 - protein, 17 aa, Brucella spp.
IPLSARFGDNVTASSPR

SEQ ID NO: 18942 - protein, 19 aa, Brucella spp.
AAKPFRFPVQYVNRPNLDF

SEQ ID NO: 18943 - protein, 24 aa, Brucella spp.
PEVADRFAADIVWFGEDPLLPGRS

SEQ ID NO: 18944 - protein, 19 aa, Brucella spp.
NRATGAFVLIDRLTNATVG

SEQ ID NO: 18945 - protein, 18 aa, Brucella spp.
LMADAGLITPVSFISPFR

SEQ ID NO: 18946 - protein, 20 aa, Brucella spp.
AGLITPVSFISPFREERDQV

SEQ ID NO: 18947 - protein, 24 aa, Brucella spp.
RARLPEGEFIEIFIDTPIEECMAR

SEQ ID NO: 18948 - protein, 19 aa, Brucella spp.
LRGEIKAFTGIDSPYEPPV

SEQ ID NO: 18949 - protein, 19 aa, Brucella spp.
PPVAPELRLNTAGRTVDEL

SEQ ID NO: 18950 - protein, 22 aa, Brucella spp.
QRLEAEAIHVFREVAATFSNPV

SEQ ID NO: 18951 - protein, 19 aa, Brucella spp.
SSVMLHLAMKAFYPAPPPF

SEQ ID NO: 18952 - protein, 18 aa, Brucella spp.
KAFYPAPPPFPFLHVDTT

SEQ ID NO: 18953 - protein, 18 aa, Brucella spp.
FPFLHVDTTWKFREMIEF

SEQ ID NO: 18954 - protein, 23 aa, Brucella spp.
LHVDTTWKFREMIEFRDAQAREK

SEQ ID NO: 18955 - protein, 18 aa, Brucella spp.
FREMIEFRDAQAREKGFE

SEQ ID NO: 18956 - protein, 30 aa, Brucella spp.
ESIRVFPLSNWTELDIWQYILQENIPIVPL

SEQ ID NO: 18957 - protein, 24 aa, Brucella spp.
ILQENIPIVPLYFAARRPVVERDG

SEQ ID NO: 18958 - protein, 17 aa, Brucella spp.
ENRLVRFRTLGCYPLTG

SEQ ID NO: 18959 - protein, 18 aa, Brucella spp.
IHYAYAMAGADILETNTF

SEQ ID NO: 18960 - protein, 24 aa, Brucella spp.
FAEKGVRLPVMISGTITDLSGRTL

SEQ ID NO: 18961 - protein, 33 aa, Brucella spp.
SGQTPTAFWYSLRHARPFTIGLNCALGANAMRA

SEQ ID NO: 18962 - protein, 29 aa, Brucella spp.
KPAKVPPLMRLSGLEPFTLTKDIPFVNIG

SEQ ID NO: 18963 - protein, 22 aa, Brucella spp.
SEKAMVEFLNLIAAEPDIARVP

SEQ ID NO: 18964 - protein, 25 aa, Brucella spp.
FLHHARLVRAYGAAVVIMAFDETGQ

SEQ ID NO: 18965 - protein, 17 aa, Brucella spp.
RAYKILTEQVGFPPEDI

SEQ ID NO: 18966 - protein, 27 aa, Brucella spp.
PVREAMHAVFLYHAIQAGMDMGIVNAG

SEQ ID NO: 18967 - protein, 17 aa, Brucella spp.
ATERLLEIAERFRDSGS

SEQ ID NO: 18968 - protein, 19 aa, Brucella spp.
VEKRLEHALVNGITEYIEA

SEQ ID NO: 18969 - protein, 24 aa, Brucella spp.
RVMKQAVAVLLPFMEEEKRLNGGE

SEQ ID NO: 18970 - protein, 24 aa, Brucella spp.
MEREGFDIPLLIGGATTSRVHTAV

SEQ ID NO: 18971 - protein, 26 aa, Brucella spp.
YDLAEIARYIDWTPFFQTWELRGRYP

SEQ ID NO: 18972 - protein, 19 aa, Brucella spp.
FFQTWELRGRYPAILEDEK

SEQ ID NO: 18973 - protein, 26 aa, Brucella spp.
IDEKWFTPRAVVGFWPANAVGDDIRL

SEQ ID NO: 18974 - protein, 24 aa, Brucella spp.
ESRKEELATLFTLRQQLTKRDGRP

SEQ ID NO: 18975 - protein, 18 aa, Brucella spp.
YAPDEAFTPEELISEPYK

SEQ ID NO: 18976 - protein, 18 aa, Brucella spp.
PYKGIRPAPGYPAQPDHT

SEQ ID NO: 18977 - protein, 24 aa, Brucella spp.
LYIGHPESYYFGVAKVERDQVEDY

SEQ ID NO: 18978 - protein, 22 aa, Brucella spp.
EAVERWLTPILNYVPGASKDEA

SEQ ID NO: 18979 - protein, 31 aa, Brucella spp.
PMKRFGYSLFAACLSIGMGLSAMSANAAQPL

SEQ ID NO: 18980 - protein, 21 aa, Brucella spp.
PIGPCGIAWRGSKIVGVEIGE

SEQ ID NO: 18981 - protein, 18 aa, Brucella spp.
YAEPPAFIRQTIEKVRAL

SEQ ID NO: 18982 - protein, 17 aa, Brucella spp.
SEPDLFGGLPLQERPQT

SEQ ID NO: 18983 - protein, 20 aa, Brucella spp.
MCERIDLVVYAEFKDEEALY

SEQ ID NO: 18984 - protein, 20 aa, Brucella spp.
KDEEALYAFKNHPTYDATTQ

SEQ ID NO: 18985 - protein, 21 aa, Brucella spp.
PAIVLPLAVWLELGEEHRRSS

SEQ ID NO: 18986 - protein, 22 aa, Brucella spp.
GHLDSIALIALQFPVFNDGRSY

SEQ ID NO: 18987 - protein, 17 aa, Brucella spp.
TPVLFLDTGKHFRATLD

SEQ ID NO: 18988 - protein, 24 aa, Brucella spp.
PMARAVAPYRAWMTGRKQFQASTR

SEQ ID NO: 18989 - protein, 20 aa, Brucella spp.
QLHAYMLRVAIPYGTLSSRQ

SEQ ID NO: 18990 - protein, 22 aa, Brucella spp.
TDPRPLAEILRQWSSLHPEFSY

SEQ ID NO: 18991 - protein, 23 aa, Brucella spp.
HPEFSYLPRKFKIAIVGSEHDRA

SEQ ID NO: 18992 - protein, 23 aa, Brucella spp.
KNEAGELGLAVYVGGGQGRTPMV

SEQ ID NO: 18993 - protein, 17 aa, Brucella spp.
IEDMLTYVTAIVRVYNL

SEQ ID NO: 18994 - protein, 17 aa, Brucella spp.
RDIDVIESYFRMPDLPQ

SEQ ID NO: 18995 - protein, 17 aa, Brucella spp.
CGGNFPCRLSPGGNGAF

SEQ ID NO: 18996 - protein, 23 aa, Brucella spp.
DKKCCLTPTLPMRMSAVPRKPGF

SEQ ID NO: 18997 - protein, 26 aa, Brucella spp.
SQTRLLADFPAFFRVSGEVVAVVGGG

SEQ ID NO: 18998 - protein, 25 aa, Brucella spp.
PFAPELLDGAKLVFVATGDEAGDRA

SEQ ID NO: 18999 - protein, 18 aa, Brucella spp.
PALCDFLTPAIVNRAPVT

SEQ ID NO: 19000 - protein, 26 aa, Brucella spp.
PRLGELAHFAESWRPLVERALPKGLA

SEQ ID NO: 19001 - protein, 30 aa, Brucella spp.
WRPLVERALPKGLARRGFWRTFFSGKVARA

SEQ ID NO: 19002 - protein, 22 aa, Brucella spp.
VVRLKSGDPLVFGRAGEEMAAL

SEQ ID NO: 19003 - protein, 27 aa, Brucella spp.
AAADMELPLTLRGVASSLVFTTGHDMT

SEQ ID NO: 19004 - protein, 17 aa, Brucella spp.
HDMTGDVLPGWAKLAVS

SEQ ID NO: 19005 - protein, 21 aa, Brucella spp.
MTGDVLPGWAKLAVSGATIAV

SEQ ID NO: 19006 - protein, 22 aa, Brucella spp.
MRARPLEPALYIVSTPIGNLGD

SEQ ID NO: 19007 - protein, 18 aa, Brucella spp.
LVSDPGFRLVGDAREAGI

SEQ ID NO: 19008 - protein, 23 aa, Brucella spp.
GLPTDAFMFCGFLPAKHGQKQSR

SEQ ID NO: 19009 - protein, 24 aa, Brucella spp.
LESLKGIDATLVFYESPNRAAATL

SEQ ID NO: 19010 - protein, 18 aa, Brucella spp.
IRGEVVLLVGPPTGEAVA

SEQ ID NO: 19011 - protein, 28 aa, Brucella spp.
KLREFDGLIGPFGFEVSSVAALGLPEPD

SEQ ID NO: 19012 - protein, 17 aa, Brucella spp.
FEVSSVAALGLPEPDET

SEQ ID NO: 19013 - protein, 17 aa, Brucella spp.
VSSVAALGLPEPDETGT

SEQ ID NO: 19014 - protein, 21 aa, Brucella spp.
RKARFVSVICLAWPDGEAEYF

SEQ ID NO: 19015 - protein, 36 aa, Brucella spp.
YFRGEVEGTLVWPPRGNIGFGYDPVFLPDGYGKTFG

SEQ ID NO: 19016 - protein, 18 aa, Brucella spp.
ARAFKLFAEKALNVVSAP

SEQ ID NO: 19017 - protein, 20 aa, Brucella spp.
EGSCLVKFGDTHVLCTASLE

SEQ ID NO: 19018 - protein, 20 aa, Brucella spp.
CGIYEGVPVLDLDYAEDSVA

SEQ ID NO: 19019 - protein, 25 aa, Brucella spp.
FSEEEFGALMKLARSGIDRLVSLQK

SEQ ID NO: 19020 - protein, 25 aa, Brucella spp.
SDLEHLGLIYAPHISAGRLPTQIGL

SEQ ID NO: 19021 - protein, 27 aa, Brucella spp.
ISAGRLPTQIGLRFFVDAFLEVGDLPP

SEQ ID NO: 19022 - protein, 29 aa, Brucella spp.
LKHIEFVRLEPMRALAVLVMQNGDVENRV

SEQ ID NO: 19023 - protein, 24 aa, Brucella spp.
LDLAEAGSGVRIFIGSENKLFSLS

SEQ ID NO: 19024 - protein, 19 aa, Brucella spp.
QRVIGALGVIGPTRLNYAR

SEQ ID NO: 19025 - protein, 29 aa, Brucella spp.
SEGVEMTERAMLLALERHGVKKLEPEGQK

SEQ ID NO: 19026 - protein, 20 aa, Brucella spp.
GQKFDPNFHQAMFEVPNPDL

SEQ ID NO: 19027 - protein, 17 aa, Brucella spp.
NTVVQVVQAGYAIGDRV

SEQ ID NO: 19028 - protein, 21 aa, Brucella spp.
EHVNAFTLLVAVVLSAQATDA

SEQ ID NO: 19029 - protein, 18 aa, Brucella spp.
KVGEYIRTIGLWRNKAKN

SEQ ID NO: 19030 - protein, 25 aa, Brucella spp.
TPEAVEAILVRVIPREYMLHAHHWL

SEQ ID NO: 19031 - protein, 19 aa, Brucella spp.
LHAHHWLILHGRYVCKARK

SEQ ID NO: 19032 - protein, 21 aa, Brucella spp.
TGCWMFVGILFWSIGAWPIFG

SEQ ID NO: 19033 - protein, 17 aa, Brucella spp.
ILFWSIGAWPIFGFFGL

SEQ ID NO: 19034 - protein, 34 aa, Brucella spp.
WSIGAWPIFGFFGLDVLLIYLAFRWNYHAARARE

SEQ ID NO: 19035 - protein, 23 aa, Brucella spp.
SERLRITLAVAGFASENLEVMTE

SEQ ID NO: 19036 - protein, 23 aa, Brucella spp.
PIAPGLELWALFGASGEPIVLSD

SEQ ID NO: 19037 - protein, 18 aa, Brucella spp.
LPEREVFETVLQRERLGS

SEQ ID NO: 19038 - protein, 24 aa, Brucella spp.
LDDQPVDLVFLLLAPENAGADHLK

SEQ ID NO: 19039 - protein, 17 aa, Brucella spp.
GTHDAQALYSFLTAHPT

SEQ ID NO: 19040 - protein, 17 aa, Brucella spp.
AQALYSFLTAHPTSNAA

SEQ ID NO: 19041 - protein, 24 aa, Brucella spp.
SGSRFSADCTLHLDSGATLQSAGE

SEQ ID NO: 19042 - protein, 18 aa, Brucella spp.
QDPQLAFDMAADKIETRL

SEQ ID NO: 19043 - protein, 23 aa, Brucella spp.
ELDLTEHPVLVFRNAGNDEVNIV

SEQ ID NO: 19044 - protein, 23 aa, Brucella spp.
SDYVAEQIVLGFSKAADRFIATA

SEQ ID NO: 19045 - protein, 19 aa, Brucella spp.
ESGYLRIDIVGLAHNLGIE

SEQ ID NO: 19046 - protein, 20 aa, Brucella spp.
LRIDIVGLAHNLGIETAEIG

SEQ ID NO: 19047 - protein, 23 aa, Brucella spp.
TAEIGRILGVLQGFDPPGLFARD

SEQ ID NO: 19048 - protein, 22 aa, Brucella spp.
LQGFDPPGLFARDLRECLAIQL

SEQ ID NO: 19049 - protein, 18 aa, Brucella spp.
DLRECLAIQLRLKDRFDP

SEQ ID NO: 19050 - protein, 20 aa, Brucella spp.
LAIQLRLKDRFDPAMEALIA

SEQ ID NO: 19051 - protein, 19 aa, Brucella spp.
ANLDLLARRDFATLQKICG

SEQ ID NO: 19052 - protein, 23 aa, Brucella spp.
VADTIVPDVLVFSARDGGWAIEL

SEQ ID NO: 19053 - protein, 23 aa, Brucella spp.
AFLTDCMQTAGWLVRSLDQRART

SEQ ID NO: 19054 - protein, 20 aa, Brucella spp.
GVAHLKPLNLRMVADAVGMH

SEQ ID NO: 19055 - protein, 25 aa, Brucella spp.
ATPRGVFELRYFFTASLASSEGGEA

SEQ ID NO: 19056 - protein, 20 aa, Brucella spp.
VRVRVLKTALPVAAIALAAV

SEQ ID NO: 19057 - protein, 29 aa, Brucella spp.
LPVAAIALAAVFSWYTFLATPASPVKVEV

SEQ ID NO: 19058 - protein, 26 aa, Brucella spp.
QVKDNGKVLIFEYNVHMTVDGNTLSA

SEQ ID NO: 19059 - protein, 28 aa, Brucella spp.
RRKLTSWRLAFLVLLAALIAGFAFYSLR

SEQ ID NO: 19060 - protein, 22 aa, Brucella spp.
LAALIAGFAFYSLRSAEFNQPH

SEQ ID NO: 19061 - protein, 17 aa, Brucella spp.
AEAVAWLQTKGLSDKLP

SEQ ID NO: 19062 - protein, 17 aa, Brucella spp.
VGSETGFSLRDLIIHAG

SEQ ID NO: 19063 - protein, 19 aa, Brucella spp.
AIKEIARDRIFLDGLLSVW

SEQ ID NO: 19064 - protein, 24 aa, Brucella spp.
IARDRIFLDGLLSVWHVDGIAGAN

SEQ ID NO: 19065 - protein, 17 aa, Brucella spp.
NRVELRGFGAFSVKNRP

SEQ ID NO: 19066 - protein, 20 aa, Brucella spp.
VELRGFGAFSVKNRPARSGR

SEQ ID NO: 19067 - protein, 19 aa, Brucella spp.
VDVEEKWVPFFKTGKKLRD

SEQ ID NO: 19068 - protein, 20 aa, Brucella spp.
GQAIWLPALPQREWDQADAI

SEQ ID NO: 19069 - protein, 17 aa, Brucella spp.
LPQREWDQADAIFTGNT

SEQ ID NO: 19070 - protein, 17 aa, Brucella spp.
MGRWAFPKTPLGETWPM

SEQ ID NO: 19071 - protein, 18 aa, Brucella spp.
MQHDGISFHGRFTSFRHV

SEQ ID NO: 19072 - protein, 18 aa, Brucella spp.
GVFPEQAAHWSFMDGLIR

SEQ ID NO: 19073 - protein, 19 aa, Brucella spp.
EQAAHWSFMDGLIRDAVKT

SEQ ID NO: 19074 - protein, 22 aa, Brucella spp.
SRCSIFSAIRAWLHSLPHALAR

SEQ ID NO: 19075 - protein, 20 aa, Brucella spp.
RDQQGVFLAEGLKLVIDALE

SEQ ID NO: 19076 - protein, 17 aa, Brucella spp.
FSVPLYRASEADFLNWR

SEQ ID NO: 19077 - protein, 27 aa, Brucella spp.
VPLYRASEADFLNWRKGFSGLVVGTHL

SEQ ID NO: 19078 - protein, 19 aa, Brucella spp.
RKGFSGLVVGTHLKGAVDY

SEQ ID NO: 19079 - protein, 22 aa, Brucella spp.
QQIDLLPFLALFRTHNEGIAFS

SEQ ID NO: 19080 - protein, 18 aa, Brucella spp.
TWSFAVFNLADAFITIGA

SEQ ID NO: 19081 - protein, 23 aa, Brucella spp.
RTVELLWQGAWAYCRRHSIDVMF

SEQ ID NO: 19082 - protein, 20 aa, Brucella spp.
RRHSIDVMFGCASFHGAVPA

SEQ ID NO: 19083 - protein, 21 aa, Brucella spp.
MPPLVKGYLRLGAMIGDGAVI

SEQ ID NO: 19084 - protein, 20 aa, Brucella spp.
FGTTDVFIILPIERISSRYI

SEQ ID NO: 19085 - protein, 25 aa, Brucella spp.
YLMDTLIDILFEFATTRAYPTRNPS

SEQ ID NO: 19086 - protein, 25 aa, Brucella spp.
AQGSDIDLLFLLPYKQTPWGEQVVE

SEQ ID NO: 19087 - protein, 25 aa, Brucella spp.
EQVVEYTLYMLWDMGLKVGHSTRNI

SEQ ID NO: 19088 - protein, 21 aa, Brucella spp.
DLHTLFWITKYFYRVKTKEEL

SEQ ID NO: 19089 - protein, 20 aa, Brucella spp.
LKLFNKAEDFLWAVRCHMHF

SEQ ID NO: 19090 - protein, 24 aa, Brucella spp.
EDFLWAVRCHMHFATLKAEERLSF

SEQ ID NO: 19091 - protein, 18 aa, Brucella spp.
PGFNRIFLTFSRRKRKLS

SEQ ID NO: 19092 - protein, 23 aa, Brucella spp.
FRQDPVNMIRLFHLADRHGLEFH

SEQ ID NO: 19093 - protein, 31 aa, Brucella spp.
RMNESGVLGKFIPDFGKIVAMMQFNMYHHYT

SEQ ID NO: 19094 - protein, 18 aa, Brucella spp.
ETVEWLVREHLTMSMVAQ

SEQ ID NO: 19095 - protein, 23 aa, Brucella spp.
TMERLKLLLILTVCDIKAVGPGI

SEQ ID NO: 19096 - protein, 20 aa, Brucella spp.
IKAVGPGIWNGWKGQLLRTL

SEQ ID NO: 19097 - protein, 26 aa, Brucella spp.
PGIWNGWKGQLLRTLFYETELVLTGG

SEQ ID NO: 19098 - protein, 24 aa, Brucella spp.
RDAYLALPYTNYFLTVSLDDQVRH

SEQ ID NO: 19099 - protein, 25 aa, Brucella spp.
RFSEEVFGVLFTVLLFLAIAMELSM

SEQ ID NO: 19100 - protein, 26 aa, Brucella spp.
LAIAMELSMPFIVRTVIAPGFTDDPV

SEQ ID NO: 19101 - protein, 24 aa, Brucella spp.
QNRSVEFTLFLTLPAAAALLVMSE

SEQ ID NO: 19102 - protein, 18 aa, Brucella spp.
FVLIKAFIPGFFAREDTR

SEQ ID NO: 19103 - protein, 18 aa, Brucella spp.
LLTRIPRLLIAAGIMAFG

SEQ ID NO: 19104 - protein, 17 aa, Brucella spp.
LLIAAGIMAFGIHYAIG

SEQ ID NO: 19105 - protein, 22 aa, Brucella spp.
GFEWSGTARVAMKREWPTWTPP

SEQ ID NO: 19106 - protein, 17 aa, Brucella spp.
WPTWTPPSAMIKRQPEL

SEQ ID NO: 19107 - protein, 21 aa, Brucella spp.
RLHGTPEWWSIGKAMSSGCIR

SEQ ID NO: 19108 - protein, 19 aa, Brucella spp.
CQCDMTFALFLPPQAKDGP

SEQ ID NO: 19109 - protein, 23 aa, Brucella spp.
QAKDGPVPVLWYLSGLTCTHQNV

SEQ ID NO: 19110 - protein, 17 aa, Brucella spp.
DNWQFGKGAGFYVDAMQ

SEQ ID NO: 19111 - protein, 17 aa, Brucella spp.
QELSALVARQFPLDMER

SEQ ID NO: 19112 - protein, 19 aa, Brucella spp.
RFKSVSAFAPIVQPSTAGW

SEQ ID NO: 19113 - protein, 20 aa, Brucella spp.
FLDDGLRPWLLEEACRKAGI

SEQ ID NO: 19114 - protein, 23 aa, Brucella spp.
EEACRKAGIALTLNMREGYDHSY

SEQ ID NO: 19115 - protein, 20 aa, Brucella spp.
EGYDHSYFFISTFMGDHLRW

SEQ ID NO: 19116 - protein, 29 aa, Brucella spp.
GVSVVNALSIWLKLKIRRAGKIHEMSFTH

SEQ ID NO: 19117 - protein, 17 aa, Brucella spp.
KIHEMSFTHGVADAPLV

SEQ ID NO: 19118 - protein, 22 aa, Brucella spp.
TEVSFLPSPDTFSMVEFDYETL

SEQ ID NO: 19119 - protein, 18 aa, Brucella spp.
LRELAFLNSGVRIKLADR

SEQ ID NO: 19120 - protein, 21 aa, Brucella spp.
LHYDGGLVEFVKYTDQSKKSL

SEQ ID NO: 19121 - protein, 25 aa, Brucella spp.
EKDGMTVEVAMWWNDSYHEKVLCFT

SEQ ID NO: 19122 - protein, 25 aa, Brucella spp.
PQRDGGTHLAGFRGALTRQITGYAD

SEQ ID NO: 19123 - protein, 19 aa, Brucella spp.
VVEGLVNEALSTWLEEHPA

SEQ ID NO: 19124 - protein, 17 aa, Brucella spp.
EEHPAGGKIVVEKVIQA

SEQ ID NO: 19125 - protein, 26 aa, Brucella spp.
DGAHIRTLLLTFFFRQMPELIERGHI

SEQ ID NO: 19126 - protein, 23 aa, Brucella spp.
RQMPELIERGHIYIAQPPLYKVT

SEQ ID NO: 19127 - protein, 18 aa, Brucella spp.
IYIAQPPLYKVTRGKSSQ

SEQ ID NO: 19128 - protein, 17 aa, Brucella spp.
RGVKDIAILDMALLGSA

SEQ ID NO: 19129 - protein, 17 aa, Brucella spp.
RMAEIFMEPPVLRRKDK

SEQ ID NO: 19130 - protein, 20 aa, Brucella spp.
SLSGPVALLDAVFATGRKGL

SEQ ID NO: 19131 - protein, 17 aa, Brucella spp.
ALLDAVFATGRKGLTLQ

SEQ ID NO: 19132 - protein, 18 aa, Brucella spp.
TDGLPVGAVSGFCNMLWK

SEQ ID NO: 19133 - protein, 27 aa, Brucella spp.
LPVGAVSGFCNMLWKLLKDARNTDVGV

SEQ ID NO: 19134 - protein, 25 aa, Brucella spp.
VGVVPTHFAVIFDYSSKTFRKEIYP

SEQ ID NO: 19135 - protein, 25 aa, Brucella spp.
TAPPEDLIPQFGLIRQATRAFNLPC

SEQ ID NO: 19136 - protein, 19 aa, Brucella spp.
CIEKEGFEADDLIATYARL

SEQ ID NO: 19137 - protein, 19 aa, Brucella spp.
VIEKWGVPPEKMIDLQSLT

SEQ ID NO: 19138 - protein, 17 aa, Brucella spp.
QLLEEFGDLDTLLARAS

SEQ ID NO: 19139 - protein, 19 aa, Brucella spp.
TDVPLDIDLDGLVLEPQNG

SEQ ID NO: 19140 - protein, 28 aa, Brucella spp.
EPQNGPKLIGFLKAMEFTSLTRRVAEAT

SEQ ID NO: 19141 - protein, 17 aa, Brucella spp.
VCIRDIATLEQWLAEAA

SEQ ID NO: 19142 - protein, 20 aa, Brucella spp.
RDIATLEQWLAEAAETGILA

SEQ ID NO: 19143 - protein, 19 aa, Brucella spp.
WLAEAAETGILAFDTETTS

SEQ ID NO: 19144 - protein, 20 aa, Brucella spp.
PMQAELVGFSLALAPGKAAY

SEQ ID NO: 19145 - protein, 22 aa, Brucella spp.
ENQIPLDMALAALKRVLEDASI

SEQ ID NO: 19146 - protein, 20 aa, Brucella spp.
KRVLEDASILKIAQNMKYDW

SEQ ID NO: 19147 - protein, 28 aa, Brucella spp.
DASILKIAQNMKYDWLVMRRHGINAVSF

SEQ ID NO: 19148 - protein, 23 aa, Brucella spp.
LSERWLGHTPIAYKDVAGSGKSA

SEQ ID NO: 19149 - protein, 21 aa, Brucella spp.
DADVTLRLWQVLKPRLAAEGL

SEQ ID NO: 19150 - protein, 23 aa, Brucella spp.
YERLERPLVDVLARMEERGIAVD

SEQ ID NO: 19151 - protein, 29 aa, Brucella spp.
EVRRRAKAINFGIIYGISAFGLANQLSIP

SEQ ID NO: 19152 - protein, 18 aa, Brucella spp.
ISAFGLANQLSIPREEAG

SEQ ID NO: 19153 - protein, 17 aa, Brucella spp.
DRLFNLLRIKSISTDPA

SEQ ID NO: 19154 - protein, 17 aa, Brucella spp.
YKADCRKAAEWLVEDLK

SEQ ID NO: 19155 - protein, 17 aa, Brucella spp.
ADCRKAAEWLVEDLKSI

SEQ ID NO: 19156 - protein, 17 aa, Brucella spp.
AEWLVEDLKSIGFDASV

SEQ ID NO: 19157 - protein, 21 aa, Brucella spp.
YDVQPVDPLSLWENDPFDPAI

SEQ ID NO: 19158 - protein, 24 aa, Brucella spp.
VNGSLPVKVTLLFEGEEESGSPSL

SEQ ID NO: 19159 - protein, 23 aa, Brucella spp.
RQELKADVALVCDTAMWDAETPA

SEQ ID NO: 19160 - protein, 17 aa, Brucella spp.
IAAEASAKVSFRLVHKQ

SEQ ID NO: 19161 - protein, 21 aa, Brucella spp.
AEASAKVSFRLVHKQDPVKIR

SEQ ID NO: 19162 - protein, 24 aa, Brucella spp.
LSDEWPKPAVLIAMGGSIPIVGDF

SEQ ID NO: 19163 - protein, 17 aa, Brucella spp.
PIVGDFNTFLGMESLLV

SEQ ID NO: 19164 - protein, 28 aa, Brucella spp.
LKDRSITKIFHFGRFDLAVLAHAFGTMP

SEQ ID NO: 19165 - protein, 18 aa, Brucella spp.
RFDLAVLAHAFGTMPQPV

SEQ ID NO: 19166 - protein, 22 aa, Brucella spp.
LEYAASDVLYLHRLKAVLEQRL

SEQ ID NO: 19167 - protein, 17 aa, Brucella spp.
ACFKFLPTRSELDLMGW

SEQ ID NO: 19168 - protein, 21 aa, Brucella spp.
FKFLPTRSELDLMGWAESDIF

SEQ ID NO: 19169 - protein, 20 aa, Brucella spp.
APDGESWRVRYFAPEMEVPF

SEQ ID NO: 19170 - protein, 17 aa, Brucella spp.
RYFAPEMEVPFCGHATI

SEQ ID NO: 19171 - protein, 20 aa, Brucella spp.
EMEVPFCGHATIALGAALAM

SEQ ID NO: 19172 - protein, 22 aa, Brucella spp.
FCGHATIALGAALAMREGDGRF

SEQ ID NO: 19173 - protein, 21 aa, Brucella spp.
EAEIGQALALFNYEPDDLAHG

SEQ ID NO: 19174 - protein, 22 aa, Brucella spp.
MSRQGWTTILLIYSETPRRFHA

SEQ ID NO: 19175 - protein, 26 aa, Brucella spp.
FAAYLRDIGWPHGGSIEVFQGEDMGS

SEQ ID NO: 19176 - protein, 26 aa, Brucella spp.
DTDFYKLLMLQMIWGLYPRVDATFSL

SEQ ID NO: 19177 - protein, 17 aa, Brucella spp.
HFHGPWTHTTMWEIPAL

SEQ ID NO: 19178 - protein, 24 aa, Brucella spp.
HTTMWEIPALAIINELRSRAAMKN

SEQ ID NO: 19179 - protein, 19 aa, Brucella spp.
YYGGNLLIVLPDAFGTAAF

SEQ ID NO: 19180 - protein, 19 aa, Brucella spp.
LIVLPDAFGTAAFLRNAPD

SEQ ID NO: 19181 - protein, 24 aa, Brucella spp.
RHFEGRVRMGFGWGTNLTNDFAGC

SEQ ID NO: 19182 - protein, 22 aa, Brucella spp.
DPKEVARYLRFFGNEERVEQLV

SEQ ID NO: 19183 - protein, 27 aa, Brucella spp.
ARGEDIPLPGYLAFPFDQRLSENGKLI

SEQ ID NO: 19184 - protein, 22 aa, Brucella spp.
DLPRRFIRQLPLYKVPLEQYEG

SEQ ID NO: 19185 - protein, 27 aa, Brucella spp.
EQYEGMPRIFALAWLYVAHTDSNFSLK

SEQ ID NO: 19186 - protein, 27 aa, Brucella spp.
TVEPLKIGELWALPSAVRYFLIENARR

SEQ ID NO: 19187 - protein, 22 aa, Brucella spp.
DMSEIDITWAALKLAEDGSRAE

SEQ ID NO: 19188 - protein, 36 aa, Brucella spp.
GYRAPFGVKALRLYRGLGLWGLFVPTAIFTVLTLLL

SEQ ID NO: 19189 - protein, 17 aa, Brucella spp.
LFVPTAIFTVLTLLLVN

SEQ ID NO: 19190 - protein, 25 aa, Brucella spp.
GLSTDLRTLFTLLAIFPAMDASYSL

SEQ ID NO: 19191 - protein, 23 aa, Brucella spp.
YSLFNVLVPWFVQPTRLIGFEYK

SEQ ID NO: 19192 - protein, 22 aa, Brucella spp.
PPEARTLVAVPTFITSRDSIDE

SEQ ID NO: 19193 - protein, 22 aa, Brucella spp.
NPRGEIYFALVSDWTDASQEIV

SEQ ID NO: 19194 - protein, 17 aa, Brucella spp.
QPRFFLLHRRRLFNEKQ

SEQ ID NO: 19195 - protein, 23 aa, Brucella spp.
ERLPKDIKYVMTLDADTRLTPEA

SEQ ID NO: 19196 - protein, 26 aa, Brucella spp.
HRWARGDWQLLPWLFSTGRGVSAITR

SEQ ID NO: 19197 - protein, 28 aa, Brucella spp.
RRSLNPILWLIAAIVGWSVLPLGAAAVW

SEQ ID NO: 19198 - protein, 24 aa, Brucella spp.
WSVLPLGAAAVWQGFLILSMFVAP

SEQ ID NO: 19199 - protein, 21 aa, Brucella spp.
QGFLILSMFVAPTFGIVTNLI

SEQ ID NO: 19200 - protein, 25 aa, Brucella spp.
SPDTLLFYFQLMWPAMAIAGLAIFF

SEQ ID NO: 19201 - protein, 26 aa, Brucella spp.
MWPAMAIAGLAIFFPLAAESHAALIA

SEQ ID NO: 19202 - protein, 19 aa, Brucella spp.
AALIAAPFVVIWFASPLIA

SEQ ID NO: 19203 - protein, 18 aa, Brucella spp.
FVVIWFASPLIAWLVSRS

SEQ ID NO: 19204 - protein, 20 aa, Brucella spp.
WFASPLIAWLVSRSAKPQDT

SEQ ID NO: 19205 - protein, 18 aa, Brucella spp.
VIAARDFGWIGFDETLDR

SEQ ID NO: 19206 - protein, 18 aa, Brucella spp.
AEAREWARILVDTCKAHT

SEQ ID NO: 19207 - protein, 23 aa, Brucella spp.
ARQLAFDMQFGFLERKERRLLSI

SEQ ID NO: 19208 - protein, 22 aa, Brucella spp.
LERKERRLLSIGFRVQENELDE

SEQ ID NO: 19209 - protein, 21 aa, Brucella spp.
ASEARLASLFAIAKGDVPVEH

SEQ ID NO: 19210 - protein, 34 aa, Brucella spp.
AKGDVPVEHWFKLGRLLVPVGWKGALLSWSGSMF

SEQ ID NO: 19211 - protein, 23 aa, Brucella spp.
QIDYATSRGLPWGISEAAFNARD

SEQ ID NO: 19212 - protein, 17 aa, Brucella spp.
ANLKRLAKLGALGRYGF

SEQ ID NO: 19213 - protein, 21 aa, Brucella spp.
KRLAKLGALGRYGFHDSVDFT

SEQ ID NO: 19214 - protein, 17 aa, Brucella spp.
EDMQGTFLFLRDMESGY

SEQ ID NO: 19215 - protein, 29 aa, Brucella spp.
MQGTFLFLRDMESGYWWSATGEPVRNPDE

SEQ ID NO: 19216 - protein, 23 aa, Brucella spp.
PAHKKVSLVFWTFAGGSRDAVEH

SEQ ID NO: 19217 - protein, 17 aa, Brucella spp.
DLWPMSISGDYPIFALR

SEQ ID NO: 19218 - protein, 20 aa, Brucella spp.
MSISGDYPIFALRIDNEADL

SEQ ID NO: 19219 - protein, 21 aa, Brucella spp.
PSGDDLRFWNGYGGFAEDGSY

SEQ ID NO: 19220 - protein, 17 aa, Brucella spp.
PWINVIANPSFGFHVSA

SEQ ID NO: 19221 - protein, 22 aa, Brucella spp.
GPGEAREIVFLLGNTADQKQAK

SEQ ID NO: 19222 - protein, 23 aa, Brucella spp.
AAFYQASGAFGFRDQLQDTLSLL

SEQ ID NO: 19223 - protein, 20 aa, Brucella spp.
EGDVQHWWLPATGAGVRTLI

SEQ ID NO: 19224 - protein, 25 aa, Brucella spp.
GKHGLPLILGGDWNDGMNLVGVKGK

SEQ ID NO: 19225 - protein, 31 aa, Brucella spp.
VKGKGESVWLGWFLAYTLKAFIPLAEARKDQ

SEQ ID NO: 19226 - protein, 18 aa, Brucella spp.
NALLRLFTPPFDVTPQEP

SEQ ID NO: 19227 - protein, 19 aa, Brucella spp.
HGATWAILALARMGKAAEA

SEQ ID NO: 19228 - protein, 25 aa, Brucella spp.
MGKAAEAWRLFSLISPVSHGRNPDV

SEQ ID NO: 19229 - protein, 30 aa, Brucella spp.
SVAPRCGQGGWTWYTGSAGWFYRVATEGIL

SEQ ID NO: 19230 - protein, 24 aa, Brucella spp.
GYEAELRFGEALYRVKVVAGAKAG

SEQ ID NO: 19231 - protein, 22 aa, Brucella spp.
RKEFARFPALHNVSLTIQSGEL

SEQ ID NO: 19232 - protein, 25 aa, Brucella spp.
SVQERNVGFVFQHYALFRHMTVADN

SEQ ID NO: 19233 - protein, 18 aa, Brucella spp.
FQHYALFRHMTVADNIGF

SEQ ID NO: 19234 - protein, 18 aa, Brucella spp.
VADNIGFGLKVRPGGTRP

SEQ ID NO: 19235 - protein, 21 aa, Brucella spp.
RRRALELLDLVQLSGLEKRYP

SEQ ID NO: 19236 - protein, 21 aa, Brucella spp.
DKPNSPFVYGFIGESSTLPVR

SEQ ID NO: 19237 - protein, 21 aa, Brucella spp.
RIAFRPRYWTLFRAGDSELPA

SEQ ID NO: 19238 - protein, 23 aa, Brucella spp.
AKFSVDKVLAYAFSDPVTKKNTI

SEQ ID NO: 19239 - protein, 23 aa, Brucella spp.
HGRNMAGARGLWRATGMKDEDFG

SEQ ID NO: 19240 - protein, 17 aa, Brucella spp.
FGKPIIAVVNSFTQFVP

SEQ ID NO: 19241 - protein, 19 aa, Brucella spp.
HVHLKDLGQLVAREIESAG

SEQ ID NO: 19242 - protein, 32 aa, Brucella spp.
DKITPGMLMAALRLNIPVVFVSGGPMEAGKVV

SEQ ID NO: 19243 - protein, 26 aa, Brucella spp.
ESVLPRSIATFSAFENAMTLDIAMGG

SEQ ID NO: 19244 - protein, 21 aa, Brucella spp.
FENAMTLDIAMGGSTNTVLHL

SEQ ID NO: 19245 - protein, 17 aa, Brucella spp.
RRVPVLCKVAPAVSSVH

SEQ ID NO: 19246 - protein, 17 aa, Brucella spp.
VPVLCKVAPAVSSVHME

SEQ ID NO: 19247 - protein, 24 aa, Brucella spp.
GKIKPGDIVLIRYEGPRGGPGMQE

SEQ ID NO: 19248 - protein, 18 aa, Brucella spp.
PGMQEMLYPTSYLKSKGL

SEQ ID NO: 19249 - protein, 23 aa, Brucella spp.
RIMYIHVPFAWLSMMCYSIMAVS

SEQ ID NO: 19250 - protein, 27 aa, Brucella spp.
WGKPMWGTWWVWDARLTSVFVLFLMYL

SEQ ID NO: 19251 - protein, 21 aa, Brucella spp.
ARLTSVFVLFLMYLGIIALSR

SEQ ID NO: 19252 - protein, 25 aa, Brucella spp.
DGSMLRPLFVMAIGFTLLFFTLHMM

SEQ ID NO: 19253 - protein, 18 aa, Brucella spp.
GVGPDLNLLARIGPAMLW

SEQ ID NO: 19254 - protein, 21 aa, Brucella spp.
LNLLARIGPAMLWIGALLATL

SEQ ID NO: 19255 - protein, 17 aa, Brucella spp.
IGPAMLWIGALLATLLG

SEQ ID NO: 19256 - protein, 19 aa, Brucella spp.
DGSLDLLLIGADRHMLAFT

SEQ ID NO: 19257 - protein, 25 aa, Brucella spp.
LSVRENLLFWQKFNGGEALDIGAAL

SEQ ID NO: 19258 - protein, 25 aa, Brucella spp.
AVDLAGVEHLPFGYLSTGQKRRVSI

SEQ ID NO: 19259 - protein, 19 aa, Brucella spp.
SIAKLLVSHRPLWIVDEPT

SEQ ID NO: 19260 - protein, 25 aa, Brucella spp.
GISSLPFSMKVLLENLLRFEDDRSV

SEQ ID NO: 19261 - protein, 18 aa, Brucella spp.
LLENLLRFEDDRSVKKSD

SEQ ID NO: 19262 - protein, 17 aa, Brucella spp.
IENVAKWLADRGKAGAE

SEQ ID NO: 19263 - protein, 18 aa, Brucella spp.
TGVPAVVDLAAMRDGIKA

SEQ ID NO: 19264 - protein, 24 aa, Brucella spp.
VIVDDFGNPLAFQHNVDLEYQRNG

SEQ ID NO: 19265 - protein, 20 aa, Brucella spp.
YRFLKWGQQAFKNFRVVPPG

SEQ ID NO: 19266 - protein, 18 aa, Brucella spp.
WGQQAFKNFRVVPPGTGI

SEQ ID NO: 19267 - protein, 25 aa, Brucella spp.
PVSMLLPEVIGFRLTGKLKEGVTAT

SEQ ID NO: 19268 - protein, 24 aa, Brucella spp.
NMGPEYGATCGFFPVDQETLKYMN

SEQ ID NO: 19269 - protein, 17 aa, Brucella spp.
DGNPVYLRDIWPSTQEI

SEQ ID NO: 19270 - protein, 17 aa, Brucella spp.
NPVYLRDIWPSTQEIQD

SEQ ID NO: 19271 - protein, 18 aa, Brucella spp.
AVQVPAGQTYAWDDNSTY

SEQ ID NO: 19272 - protein, 24 aa, Brucella spp.
MIGDVKGARILGLFGDKITTDHIS

SEQ ID NO: 19273 - protein, 25 aa, Brucella spp.
EYKAEGVPLVVFAGVEYGNGSSRDW

SEQ ID NO: 19274 - protein, 19 aa, Brucella spp.
RSNLVGMGIVPFVFEEGTS

SEQ ID NO: 19275 - protein, 19 aa, Brucella spp.
VFEEGTSWQSLGLKGDEIV

SEQ ID NO: 19276 - protein, 23 aa, Brucella spp.
YADDPNVLALSFHVNYWDYMGWR

SEQ ID NO: 19277 - protein, 18 aa, Brucella spp.
SFHVNYWDYMGWRDTLAT

SEQ ID NO: 19278 - protein, 17 aa, Brucella spp.
FHAKMIYTPQAIINGAV

SEQ ID NO: 19279 - protein, 26 aa, Brucella spp.
KKPRDPVHVVLFYFRDSATIPITEGE

SEQ ID NO: 19280 - protein, 18 aa, Brucella spp.
DVTGCAVVLQETRSDNSL

SEQ ID NO: 19281 - protein, 20 aa, Brucella spp.
LFASPLRWVIMLAPLAAVFF

SEQ ID NO: 19282 - protein, 18 aa, Brucella spp.
RWVIMLAPLAAVFFLSFR

SEQ ID NO: 19283 - protein, 19 aa, Brucella spp.
AVFFLSFRIQSLSVGTAQA

SEQ ID NO: 19284 - protein, 18 aa, Brucella spp.
AVSRDFLDRMGLSLGARV

SEQ ID NO: 19285 - protein, 20 aa, Brucella spp.
FLDRMGLSLGARVLLGSQTF

SEQ ID NO: 19286 - protein, 25 aa, Brucella spp.
DLLSSGFNFAPRFLVSLEGLHAAGL

SEQ ID NO: 19287 - protein, 26 aa, Brucella spp.
SLGAPARFAVLVYLIQIMVIGLIGIA

SEQ ID NO: 19288 - protein, 18 aa, Brucella spp.
PGALALAAIFGLVTTLAF

SEQ ID NO: 19289 - protein, 18 aa, Brucella spp.
LVTTLAFAIIPLGRARDI

SEQ ID NO: 19290 - protein, 20 aa, Brucella spp.
GRARDIPATALFREQGGEQR

SEQ ID NO: 19291 - protein, 17 aa, Brucella spp.
IPATALFREQGGEQRGR

SEQ ID NO: 19292 - protein, 23 aa, Brucella spp.
EQRGRPALFYLGLAILLIAALAG

SEQ ID NO: 19293 - protein, 21 aa, Brucella spp.
RLVADGIRWLARRAPRVRSTA

SEQ ID NO: 19294 - protein, 22 aa, Brucella spp.
MKIPPEAAWVLRGDRGITFAEK

SEQ ID NO: 19295 - protein, 17 aa, Brucella spp.
YSGEPLVSFSGREGKEL

SEQ ID NO: 19296 - protein, 24 aa, Brucella spp.
VQWETLAMNFVMVFSPDTFAGAPA

SEQ ID NO: 19297 - protein, 21 aa, Brucella spp.
VVEIMKLKAIFLPDVALMTVV

SEQ ID NO: 19298 - protein, 18 aa, Brucella spp.
VALMTVVIALVLTVGFGL

SEQ ID NO: 19299 - protein, 21 aa, Brucella spp.
LVLTVGFGLAGTWRVLGQKPA

SEQ ID NO: 19300 - protein, 17 aa, Brucella spp.
WSIPDGTNLVILELGAN

SEQ ID NO: 19301 - protein, 19 aa, Brucella spp.
AGKFNPIYPRLARKYDVPL

SEQ ID NO: 19302 - protein, 26 aa, Brucella spp.
LARKYDVPLYPFFLDGVATRKGLLLE

SEQ ID NO: 19303 - protein, 22 aa, Brucella spp.
IPRDAALSLSLLRGGLPGARWI

SEQ ID NO: 19304 - protein, 20 aa, Brucella spp.
ANFATLPFKVGRFVLMSSRD

SEQ ID NO: 19305 - protein, 21 aa, Brucella spp.
IKQFDAWGAYSYQSGNGKVCY

SEQ ID NO: 19306 - protein, 31 aa, Brucella spp.
ERQVKMRISQLWHWLYVRGVSDFADMRNISK

SEQ ID NO: 19307 - protein, 22 aa, Brucella spp.
QDGTRKWLFRFPPRGAGRPVEI

SEQ ID NO: 19308 - protein, 23 aa, Brucella spp.
TGDEIGVMLAISLHAVRDELRDI

SEQ ID NO: 19309 - protein, 24 aa, Brucella spp.
GIPAKINLIPFNPWPGTNYQCSDW

SEQ ID NO: 19310 - protein, 23 aa, Brucella spp.
SGGLDTSIILKWLQTELGAEVVT

SEQ ID NO: 19311 - protein, 24 aa, Brucella spp.
EEFVRDFVFPMFRANAVYEGVYLL

SEQ ID NO: 19312 - protein, 27 aa, Brucella spp.
YALNPDIKIIAPWRDWSFKSRTQLLEF

SEQ ID NO: 19313 - protein, 18 aa, Brucella spp.
RTQLLEFAEQHQIPVAKD

SEQ ID NO: 19314 - protein, 24 aa, Brucella spp.
APDKATIIKIGFEKGDAVSINGER

SEQ ID NO: 19315 - protein, 27 aa, Brucella spp.
ELMPRYAELIYYGFWFSPEREMLQAAI

SEQ ID NO: 19316 - protein, 19 aa, Brucella spp.
GEVTLKLYKGNVMVIGRES

SEQ ID NO: 19317 - protein, 19 aa, Brucella spp.
RALPLLLFVWSVAFVGIML

SEQ ID NO: 19318 - protein, 22 aa, Brucella spp.
RFDRLSILLYLALGWSGVMVYD

SEQ ID NO: 19319 - protein, 18 aa, Brucella spp.
EIALLFEQMVNQPQDAHE

SEQ ID NO: 19320 - protein, 19 aa, Brucella spp.
QTEAITLILRKWLTHERYL

SEQ ID NO: 19321 - protein, 20 aa, Brucella spp.
EAKKYPAIVVAHPISSCKEQ

SEQ ID NO: 19322 - protein, 23 aa, Brucella spp.
AKLAELGYVALAFDASTQGTSGG

SEQ ID NO: 19323 - protein, 23 aa, Brucella spp.
FRCAADYLVTLDFVDENRIGVLG

SEQ ID NO: 19324 - protein, 20 aa, Brucella spp.
STGAAFNWDAFHLADQLLTQ

SEQ ID NO: 19325 - protein, 18 aa, Brucella spp.
KSDVVSLGLVSDIFIADG

SEQ ID NO: 19326 - protein, 24 aa, Brucella spp.
IFIADGKVFFSITVPAERAEALEP

SEQ ID NO: 19327 - protein, 19 aa, Brucella spp.
AERAEALEPMRLAAEKVVK

SEQ ID NO: 19328 - protein, 18 aa, Brucella spp.
ALEPMRLAAEKVVKDIPG

SEQ ID NO: 19329 - protein, 22 aa, Brucella spp.
YGPSMPRLLGLSGRPETVEGRI

SEQ ID NO: 19330 - protein, 17 aa, Brucella spp.
EGRILKPMENYGIKVMS

SEQ ID NO: 19331 - protein, 22 aa, Brucella spp.
VDEETPMIWRGPMVMSALTQML

SEQ ID NO: 19332 - protein, 19 aa, Brucella spp.
VDVPLLGIVENMSYFIAPD

SEQ ID NO: 19333 - protein, 28 aa, Brucella spp.
ERLNVPFLGEVPLHMDVRAYSDNGTPIT

SEQ ID NO: 19334 - protein, 18 aa, Brucella spp.
NCLILGFDTMKNHRLFAS

SEQ ID NO: 19335 - protein, 23 aa, Brucella spp.
PSDFYDEFVVVGQLAPFDKDTTL

SEQ ID NO: 19336 - protein, 17 aa, Brucella spp.
KDTTLSFPVTQFCGDAA

SEQ ID NO: 19337 - protein, 18 aa, Brucella spp.
RKLEGGLDLPAGKTMQLK

SEQ ID NO: 19338 - protein, 18 aa, Brucella spp.
EEGETVPVTLEFKKAGKV

SEQ ID NO: 19339 - protein, 17 aa, Brucella spp.
FKKAGKVEINFPVTAKK

SEQ ID NO: 19340 - protein, 21 aa, Brucella spp.
KAGKVEINFPVTAKKGQTKDH

SEQ ID NO: 19341 - protein, 19 aa, Brucella spp.
CAIFSPLIDASLRPFAATA

SEQ ID NO: 19342 - protein, 17 aa, Brucella spp.
AGFETGSIIPWEMTWSL

SEQ ID NO: 19343 - protein, 27 aa, Brucella spp.
ETGSIIPWEMTWSLYLEELGPSEATRA

SEQ ID NO: 19344 - protein, 25 aa, Brucella spp.
LRHCAACPLRAFPFDSHHVCREECL

SEQ ID NO: 19345 - protein, 22 aa, Brucella spp.
GDMPIELRHFVDLNETMPEQPY

SEQ ID NO: 19346 - protein, 19 aa, Brucella spp.
GPYALPAIPYEKVPKQFRR

SEQ ID NO: 19347 - protein, 26 aa, Brucella spp.
VVSLKDHFLYYVLPGGEALRYGVGIG

SEQ ID NO: 19348 - protein, 23 aa, Brucella spp.
LPGGEALRYGVGIGKAGFEWQGR

SEQ ID NO: 19349 - protein, 18 aa, Brucella spp.
GPTNPLGARALYIYQNGR

SEQ ID NO: 19350 - protein, 25 aa, Brucella spp.
AFFVFVVAAAVFAWPEQKVQMPAQA

SEQ ID NO: 19351 - protein, 23 aa, Brucella spp.
QAEEEKSYFLSFVENKLSAPNRR

SEQ ID NO: 19352 - protein, 32 aa, Brucella spp.
GVWLRIENVKLDWSRTALFLGRLSVQSLTAER

SEQ ID NO: 19353 - protein, 25 aa, Brucella spp.
SFSLPELPISINLEQLDVARLHFGP

SEQ ID NO: 19354 - protein, 25 aa, Brucella spp.
QLDVARLHFGPTIFGLESDVSLKGS

SEQ ID NO: 19355 - protein, 24 aa, Brucella spp.
GTLDDLKVALALDTNGSRTLTGEF

SEQ ID NO: 19356 - protein, 26 aa, Brucella spp.
GKGPDGGRVFAARFNGPIAVLVPPVF

SEQ ID NO: 19357 - protein, 28 aa, Brucella spp.
FNGPIAVLVPPVFRDFFGAETVLSADGL

SEQ ID NO: 19358 - protein, 23 aa, Brucella spp.
DRPTNDWTGMLSINGLKNATLSA

SEQ ID NO: 19359 - protein, 19 aa, Brucella spp.
ADIAEALGGKITLAVNGAW

SEQ ID NO: 19360 - protein, 21 aa, Brucella spp.
LGGKITLAVNGAWRAGSPVEL

SEQ ID NO: 19361 - protein, 18 aa, Brucella spp.
LAVNGAWRAGSPVELAQA

SEQ ID NO: 19362 - protein, 24 aa, Brucella spp.
SLDLKGKINVFAFNGDIAAKVASL

SEQ ID NO: 19363 - protein, 25 aa, Brucella spp.
TGMVRPISGAFQLDFDGTAENVRTG

SEQ ID NO: 19364 - protein, 23 aa, Brucella spp.
RSSEGFSARNFRIGNALSEITAN

SEQ ID NO: 19365 - protein, 23 aa, Brucella spp.
SDKADFDFGVMLSDLKLLSDKAS

SEQ ID NO: 19366 - protein, 23 aa, Brucella spp.
ARGDDKLIALALRADVPQGTLAG

SEQ ID NO: 19367 - protein, 18 aa, Brucella spp.
RVDLGSLIDIAHDEKRLT

SEQ ID NO: 19368 - protein, 24 aa, Brucella spp.
LDAPDISTAAALFLADATGAANAD

SEQ ID NO: 19369 - protein, 32 aa, Brucella spp.
LTNLPLALANTFKPELGLGGTVNGTARITGTK

SEQ ID NO: 19370 - protein, 20 aa, Brucella spp.
EAPDIAFDMTARDVMAAELK

SEQ ID NO: 19371 - protein, 17 aa, Brucella spp.
SGLAPLTLQAAGKYAAK

SEQ ID NO: 19372 - protein, 25 aa, Brucella spp.
VNGNVPLALANRFLADRGAQASGTL

SEQ ID NO: 19373 - protein, 23 aa, Brucella spp.
VANFPANIEVKFNRARYADGKLV

SEQ ID NO: 19374 - protein, 19 aa, Brucella spp.
ITVPENLGGGAAYVPVHHK

SEQ ID NO: 19375 - protein, 25 aa, Brucella spp.
PITNIRPVGSFDLIRGRISILGQRI

SEQ ID NO: 19376 - protein, 33 aa, Brucella spp.
LPQDEVLAQLIFKRSIGKLSAFQIAQLAAAAAE

SEQ ID NO: 19377 - protein, 20 aa, Brucella spp.
DISRNLKVKGAFGAEDDSSG

SEQ ID NO: 19378 - protein, 30 aa, Brucella spp.
SSFALSPALAFEIFGIHLWGKDKKQDPDII

SEQ ID NO: 19379 - protein, 21 aa, Brucella spp.
ITVDPGPQFLFSRTAISNIAP

SEQ ID NO: 19380 - protein, 17 aa, Brucella spp.
LKAERLAVEAWRQEGYA

SEQ ID NO: 19381 - protein, 21 aa, Brucella spp.
RLGRMEVFRAMTFEEADKIEP

SEQ ID NO: 19382 - protein, 17 aa, Brucella spp.
GFGAEYSTIDGFGVTSY

SEQ ID NO: 19383 - protein, 20 aa, Brucella spp.
YSTIDGFGVTSYWMHRNLLG

SEQ ID NO: 19384 - protein, 18 aa, Brucella spp.
GVTSYWMHRNLLGRGERL

SEQ ID NO: 19385 - protein, 22 aa, Brucella spp.
PKNYTYLLGASFAKPGVYTPDT

SEQ ID NO: 19386 - protein, 18 aa, Brucella spp.
DVFGKRDFTTAGLEGNLL

SEQ ID NO: 19387 - protein, 20 aa, Brucella spp.
PSSGFYLVGNIQPFYEFHYG

SEQ ID NO: 19388 - protein, 25 aa, Brucella spp.
LVGNIQPFYEFHYGNFATRFTAEGR

SEQ ID NO: 19389 - protein, 27 aa, Brucella spp.
FSEQMRVGVGGGLRYLTSLGPIRLDVA

SEQ ID NO: 19390 - protein, 23 aa, Brucella spp.
SLGPIRLDVAVPLNRRSGDPNYG

SEQ ID NO: 19391 - protein, 22 aa, Brucella spp.
QILVHLIYFLYLDPKSEGGWNM

SEQ ID NO: 19392 - protein, 17 aa, Brucella spp.
SEGGWNMLALVFTGIIL

SEQ ID NO: 19393 - protein, 17 aa, Brucella spp.
ITSGLIWILVLSAMLLR

SEQ ID NO: 19394 - protein, 17 aa, Brucella spp.
PYHEPIIMVTLAAVAGG

SEQ ID NO: 19395 - protein, 17 aa, Brucella spp.
VMYIVLALVMLFRGFSD

SEQ ID NO: 19396 - protein, 18 aa, Brucella spp.
GVIMIFFVAMPFIVGLMN

SEQ ID NO: 19397 - protein, 17 aa, Brucella spp.
VAFPYLNSLSFWLTVAG

SEQ ID NO: 19398 - protein, 20 aa, Brucella spp.
PYLNSLSFWLTVAGAILVNI

SEQ ID NO: 19399 - protein, 18 aa, Brucella spp.
VGMDYYLWALNISGMGTL

SEQ ID NO: 19400 - protein, 19 aa, Brucella spp.
VYILVLPCFGIYSEIIATF

SEQ ID NO: 19401 - protein, 23 aa, Brucella spp.
VRMETPVMWTIGFMCTFVIGGMT

SEQ ID NO: 19402 - protein, 25 aa, Brucella spp.
VLFGCFAGVVYWWPKAFGFKLNERL

SEQ ID NO: 19403 - protein, 27 aa, Brucella spp.
LGKNAFWCWLVGFMLAFMPLYVLGLMG

SEQ ID NO: 19404 - protein, 27 aa, Brucella spp.
LSIPFGFAMIWHIWWLAIASALAMFVV

SEQ ID NO: 19405 - protein, 18 aa, Brucella spp.
ERDLILFATGIMLLVVVP

SEQ ID NO: 19406 - protein, 23 aa, Brucella spp.
VPVILATLFFAWKYRATNEKADY

SEQ ID NO: 19407 - protein, 24 aa, Brucella spp.
STKIELAVWLIPMAIIVVLGTVTW

SEQ ID NO: 19408 - protein, 25 aa, Brucella spp.
VEVVALDWKWLFIYPDQGIATVNEM

SEQ ID NO: 19409 - protein, 25 aa, Brucella spp.
NEMAMPVNVPVNFKLTSSNLMNSFF

SEQ ID NO: 19410 - protein, 19 aa, Brucella spp.
DAAALAIGRLLAGNGIEPG

SEQ ID NO: 19411 - protein, 25 aa, Brucella spp.
GQMVATIKIIPFAVPGVLIEEIRAV

SEQ ID NO: 19412 - protein, 20 aa, Brucella spp.
KVGSACDLIVIFSASAVADE

SEQ ID NO: 19413 - protein, 24 aa, Brucella spp.
RAIRRAGGEILRIGMPVDPGNLLV

SEQ ID NO: 19414 - protein, 25 aa, Brucella spp.
RIGMPVDPGNLLVLGKMGRKYIIAA

SEQ ID NO: 19415 - protein, 20 aa, Brucella spp.
PAKEEVSIATLLQSADPARG

SEQ ID NO: 19416 - protein, 17 aa, Brucella spp.
VSIATLLQSADPARGEV

SEQ ID NO: 19417 - protein, 19 aa, Brucella spp.
VGPHLWGVVGRPAASVEGF

SEQ ID NO: 19418 - protein, 24 aa, Brucella spp.
AGNKWDFEHLNKFLTSPKGFIKGT

SEQ ID NO: 19419 - protein, 20 aa, Brucella spp.
NERADLIAYLRTLSDNPVPL

SEQ ID NO: 19420 - protein, 18 aa, Brucella spp.
TLIPARLGSTRLPNKPLA

SEQ ID NO: 19421 - protein, 25 aa, Brucella spp.
APYGEGPLYHHIGLYAYRRSALERF

SEQ ID NO: 19422 - protein, 25 aa, Brucella spp.
LEQLRALEAGMRIDVEIVKTVPLGV

SEQ ID NO: 19423 - protein, 17 aa, Brucella spp.
IDVEIVKTVPLGVDTQA

SEQ ID NO: 19424 - protein, 17 aa, Brucella spp.
RVADIHYLLPLADMHIV

SEQ ID NO: 19425 - protein, 20 aa, Brucella spp.
ADIHYLLPLADMHIVGEYFL

SEQ ID NO: 19426 - protein, 27 aa, Brucella spp.
IVGEYFLPIHFQLMVLPGVRREEIKTV

SEQ ID NO: 19427 - protein, 19 aa, Brucella spp.
NDERIVTTFVFRVRNVPAA

SEQ ID NO: 19428 - protein, 19 aa, Brucella spp.
IVTTFVFRVRNVPAALYKA

SEQ ID NO: 19429 - protein, 20 aa, Brucella spp.
ERSVQLALEELRFFTKEVRI

SEQ ID NO: 19430 - protein, 18 aa, Brucella spp.
LEELRFFTKEVRILGVYK

SEQ ID NO: 19431 - protein, 21 aa, Brucella spp.
PEMEPSRFVGFAGNRIERLSE

SEQ ID NO: 19432 - protein, 17 aa, Brucella spp.
LELPETRIMILGDHKLL

SEQ ID NO: 19433 - protein, 17 aa, Brucella spp.
LPETRIMILGDHKLLLD

SEQ ID NO: 19434 - protein, 21 aa, Brucella spp.
PEALPAPFRLQDYRSVYTEGL

SEQ ID NO: 19435 - protein, 19 aa, Brucella spp.
RTDPVAIMLPVRGEKCILA

SEQ ID NO: 19436 - protein, 18 aa, Brucella spp.
FEEMKLAIGRVAYHASQP

SEQ ID NO: 19437 - protein, 23 aa, Brucella spp.
YHASQPWPFPYSLMIGCHAEVLS

SEQ ID NO: 19438 - protein, 20 aa, Brucella spp.
SELEDGRWFSKAEVRTMLEG

SEQ ID NO: 19439 - protein, 22 aa, Brucella spp.
NDRRWPWLILVPRRPGLTEIHQ

SEQ ID NO: 19440 - protein, 17 aa, Brucella spp.
PGLTEIHQMTPLDQTML

SEQ ID NO: 19441 - protein, 22 aa, Brucella spp.
EGDAGWPGPVWGHGVRETYDEK

SEQ ID NO: 19442 - protein, 26 aa, Brucella spp.
NAFETGRIAQAWMLTGVRGVGKTTTA

SEQ ID NO: 19443 - protein, 18 aa, Brucella spp.
HMLSTAAFNGLLKTLEEP

SEQ ID NO: 19444 - protein, 25 aa, Brucella spp.
LEEPPPHVKFIFATTEIRKVPITVL

SEQ ID NO: 19445 - protein, 20 aa, Brucella spp.
KVPITVLSRCQRFDLRRIES

SEQ ID NO: 19446 - protein, 17 aa, Brucella spp.
LADRARIIDLFEMLMRG

SEQ ID NO: 19447 - protein, 20 aa, Brucella spp.
LMRGDVAGALTEFRAQYDVG

SEQ ID NO: 19448 - protein, 24 aa, Brucella spp.
VRGREFAQTLSIRALSRTWQMLLK

SEQ ID NO: 19449 - protein, 22 aa, Brucella spp.
IRALSRTWQMLLKGIAEVDTAT

SEQ ID NO: 19450 - protein, 24 aa, Brucella spp.
PVQAAEMLLIRLAHAADLPTLDEA

SEQ ID NO: 19451 - protein, 18 aa, Brucella spp.
DMQFKILVKNCVRPASIA

SEQ ID NO: 19452 - protein, 30 aa, Brucella spp.
LPSDIAQHLLNWTGIRWVVTVARDVAGQTI

SEQ ID NO: 19453 - protein, 23 aa, Brucella spp.
ADPDVAAILAAFPGAKIIDVRIA

SEQ ID NO: 19454 - protein, 22 aa, Brucella spp.
EDEVEILEDLIIAAHNDAKAKL

SEQ ID NO: 19455 - protein, 21 aa, Brucella spp.
EIERLIQLLARVPGLGPRSAR

SEQ ID NO: 19456 - protein, 19 aa, Brucella spp.
KKEALLVPLGGAMQEAAEK

SEQ ID NO: 19457 - protein, 19 aa, Brucella spp.
RADTMNVRYHVLGGRLSPL

SEQ ID NO: 19458 - protein, 20 aa, Brucella spp.
RLAHGVPVGGELDYLDEGTL

SEQ ID NO: 19459 - protein, 18 aa, Brucella spp.
AWLEALVIAILLGTAVRS

SEQ ID NO: 19460 - protein, 19 aa, Brucella spp.
EALVIAILLGTAVRSLARP

SEQ ID NO: 19461 - protein, 18 aa, Brucella spp.
KLLLEIAVVLLGASISAS

SEQ ID NO: 19462 - protein, 25 aa, Brucella spp.
PGFFQLVPWFIIGFLAMMALHSLHL

SEQ ID NO: 19463 - protein, 19 aa, Brucella spp.
LKVEGRVPLKEFGAKGKDG

SEQ ID NO: 19464 - protein, 26 aa, Brucella spp.
GGFTVDLDGAVAFLPRSQVDIRPIRD

SEQ ID NO: 19465 - protein, 23 aa, Brucella spp.
DVTPLMHVPQPFEILKMDKRRGN

SEQ ID NO: 19466 - protein, 20 aa, Brucella spp.
KNITDYGAFVDLGGIDGLLH

SEQ ID NO: 19467 - protein, 24 aa, Brucella spp.
GGIDGLLHVTDMAWRRVNHPSEIL

SEQ ID NO: 19468 - protein, 25 aa, Brucella spp.
KQLESDPWDGIGAKYPIGKKITGTV

SEQ ID NO: 19469 - protein, 18 aa, Brucella spp.
IGAKYPIGKKITGTVTNI

SEQ ID NO: 19470 - protein, 18 aa, Brucella spp.
PGIEGLIHVSEMSWTKKN

SEQ ID NO: 19471 - protein, 17 aa, Brucella spp.
RRISLGLKQTLDNPWTT

SEQ ID NO: 19472 - protein, 25 aa, Brucella spp.
VKNKTEFGLFIGLDGDVDGMVHLSD

SEQ ID NO: 19473 - protein, 17 aa, Brucella spp.
LSDLDWNRPGEQVIEEY

SEQ ID NO: 19474 - protein, 19 aa, Brucella spp.
AASKVAVMPAVRRALVEAQ

SEQ ID NO: 19475 - protein, 24 aa, Brucella spp.
GTVVCPDAAIKLFVTASPEVRARR

SEQ ID NO: 19476 - protein, 17 aa, Brucella spp.
VRARRRFDEVLARGDTA

SEQ ID NO: 19477 - protein, 21 aa, Brucella spp.
SEMSIEAAFLAAKKLIDHALA

SEQ ID NO: 19478 - protein, 18 aa, Brucella spp.
RLTMGLVGTYDMKTSFIG

SEQ ID NO: 19479 - protein, 21 aa, Brucella spp.
RPMGRVLNPLREMGVQVEAAE

SEQ ID NO: 19480 - protein, 20 aa, Brucella spp.
EGDRMPLTLIGPRTANPIAY

SEQ ID NO: 19481 - protein, 17 aa, Brucella spp.
MNPTRTGLILTLQEMGA

SEQ ID NO: 19482 - protein, 23 aa, Brucella spp.
SMIDEYPVLAIAASFAEGETVMD

SEQ ID NO: 19483 - protein, 25 aa, Brucella spp.
GTHLDHRIAMSFLVMGLASEKPVTV

SEQ ID NO: 19484 - protein, 23 aa, Brucella spp.
ATSFPEFMGMMAGLGAKIAESGA

SEQ ID NO: 19485 - protein, 20 aa, Brucella spp.
NEALQGFILTFAYFTDVFFI

SEQ ID NO: 19486 - protein, 21 aa, Brucella spp.
VFRTLPSFLFGMWIAHSQPTR

SEQ ID NO: 19487 - protein, 19 aa, Brucella spp.
LEGPWRLGFLYCCTYLLYA

SEQ ID NO: 19488 - protein, 23 aa, Brucella spp.
FILHPLVALFFFKATPEQWGETT

SEQ ID NO: 19489 - protein, 21 aa, Brucella spp.
GENRLPCIYLVDSGGANLPNQ

SEQ ID NO: 19490 - protein, 20 aa, Brucella spp.
DAHALQIARAIAANLASEKR

SEQ ID NO: 19491 - protein, 20 aa, Brucella spp.
KARYGTTLVCSFASVYGMPV

SEQ ID NO: 19492 - protein, 21 aa, Brucella spp.
TTLVCSFASVYGMPVSIITNN

SEQ ID NO: 19493 - protein, 17 aa, Brucella spp.
FASVYGMPVSIITNNGV

SEQ ID NO: 19494 - protein, 28 aa, Brucella spp.
HFIELCCQRNIPLVFLQNITGFMVGRKY

SEQ ID NO: 19495 - protein, 17 aa, Brucella spp.
PKITMLIGASYGAGNYG

SEQ ID NO: 19496 - protein, 30 aa, Brucella spp.
MAGRAYSPRFLWTWPNSRIAVMGGEQAAGV

SEQ ID NO: 19497 - protein, 23 aa, Brucella spp.
GAEAIHPGYGFLSENPAFVDAVE

SEQ ID NO: 19498 - protein, 17 aa, Brucella spp.
AGLIFIGPSAKAIRAMG

SEQ ID NO: 19499 - protein, 23 aa, Brucella spp.
SEADRITYPVLIKARAGGGGKGM

SEQ ID NO: 19500 - protein, 20 aa, Brucella spp.
GEAAVKAALTIGYSGAGTVE

SEQ ID NO: 19501 - protein, 22 aa, Brucella spp.
VSEGLRPDRFFFMEMNTRLQVE

SEQ ID NO: 19502 - protein, 25 aa, Brucella spp.
PVTEAITGLDLVEWQLRVASGEALP

SEQ ID NO: 19503 - protein, 17 aa, Brucella spp.
QDELSINGWAFEARLYA

SEQ ID NO: 19504 - protein, 24 aa, Brucella spp.
ARDFLPATGKLALFVPPENARVDS

SEQ ID NO: 19505 - protein, 23 aa, Brucella spp.
AQPSDIAFALAALGALDLLDAPE

SEQ ID NO: 19506 - protein, 25 aa, Brucella spp.
EKSDPWSGLRGFRLWGEASRSVLIE

SEQ ID NO: 19507 - protein, 20 aa, Brucella spp.
FRLWGEASRSVLIEHHGERR

SEQ ID NO: 19508 - protein, 23 aa, Brucella spp.
FTARGDRHFGFAFGTMDIRAHKN

SEQ ID NO: 19509 - protein, 17 aa, Brucella spp.
FGFAFGTMDIRAHKNGL

SEQ ID NO: 19510 - protein, 17 aa, Brucella spp.
VAFAATIGFASAAYADI

SEQ ID NO: 19511 - protein, 17 aa, Brucella spp.
FAATIGFASAAYADITI

SEQ ID NO: 19512 - protein, 23 aa, Brucella spp.
IVGDGIKFVVGLVTTGVAVPVSD

SEQ ID NO: 19513 - protein, 17 aa, Brucella spp.
AEVMADYVLKNMKDKKV

SEQ ID NO: 19514 - protein, 18 aa, Brucella spp.
VMADYVLKNMKDKKVAVI

SEQ ID NO: 19515 - protein, 21 aa, Brucella spp.
KSAGAEVVYFGGYHAEGGLLS

SEQ ID NO: 19516 - protein, 18 aa, Brucella spp.
EGGLLSRQLHDAGMQALV

SEQ ID NO: 19517 - protein, 18 aa, Brucella spp.
LSNTEYWAIGGTNAQGTL

SEQ ID NO: 19518 - protein, 19 aa, Brucella spp.
DAHNAEALIAGFDVVVDGS

SEQ ID NO: 19519 - protein, 20 aa, Brucella spp.
PSCAEAGVLGVLPGVIGSLQ

SEQ ID NO: 19520 - protein, 27 aa, Brucella spp.
VTGIGEPLVGRLLLYNALNVRFETIRY

SEQ ID NO: 19521 - protein, 22 aa, Brucella spp.
YAELSLPLGPGHVVLTGENGSG

SEQ ID NO: 19522 - protein, 21 aa, Brucella spp.
TNLIEAISFLSPGRGLRRAAY

SEQ ID NO: 19523 - protein, 21 aa, Brucella spp.
DLLDYARILWVVPSMDGLFTG

SEQ ID NO: 19524 - protein, 18 aa, Brucella spp.
RAQAMRLIAAMIERLPAE

SEQ ID NO: 19525 - protein, 22 aa, Brucella spp.
GEQKALLIGLILAHARLTAELS

SEQ ID NO: 19526 - protein, 19 aa, Brucella spp.
LSGMAPILLLDEIAAHLDM

SEQ ID NO: 19527 - protein, 18 aa, Brucella spp.
HLDMGRRAALFGILDELG

SEQ ID NO: 19528 - protein, 17 aa, Brucella spp.
VPAHLLYDIVRKLPDGA

SEQ ID NO: 19529 - protein, 25 aa, Brucella spp.
PQSDFPELTAGAFTHSFRIEAQALK

SEQ ID NO: 19530 - protein, 28 aa, Brucella spp.
FTHSFRIEAQALKRLIDRTQFAISTEET

SEQ ID NO: 19531 - protein, 19 aa, Brucella spp.
TRYYLNGIFFHAIESDGAL

SEQ ID NO: 19532 - protein, 19 aa, Brucella spp.
ESDGALKLRAVATDGHRLA

SEQ ID NO: 19533 - protein, 17 aa, Brucella spp.
RGRAVKLSIADGQLTLT

SEQ ID NO: 19534 - protein, 20 aa, Brucella spp.
SAASRPIWFVAKNALDEAAL

SEQ ID NO: 19535 - protein, 19 aa, Brucella spp.
RRLAEAVTLVRDLINTPAN

SEQ ID NO: 19536 - protein, 23 aa, Brucella spp.
MDAKLPVRLRVLIPAIENAIAGN

SEQ ID NO: 19537 - protein, 24 aa, Brucella spp.
ETADPLWRMPLWQPYAQKLSSRVA

SEQ ID NO: 19538 - protein, 25 aa, Brucella spp.
RARQWAHFDIFGWVPVEKPASPVGG

SEQ ID NO: 19539 - protein, 18 aa, Brucella spp.
IAGFALGLAAFFPSAVSV

SEQ ID NO: 19540 - protein, 19 aa, Brucella spp.
EVNGIEMYYRVVGKGPPIL

SEQ ID NO: 19541 - protein, 21 aa, Brucella spp.
IAMRYPDRLNSLFAQAANVSP

SEQ ID NO: 19542 - protein, 23 aa, Brucella spp.
VRPDDWYFPCHFQGNPIMPGCLG

SEQ ID NO: 19543 - protein, 26 aa, Brucella spp.
GLDGMWQLTGFFLGWLGEPGRGMALS

SEQ ID NO: 19544 - protein, 20 aa, Brucella spp.
LGWLGEPGRGMALSTGEVKF

SEQ ID NO: 19545 - protein, 21 aa, Brucella spp.
AEEYAKLGFRCQVHGAPDIDI

SEQ ID NO: 19546 - protein, 23 aa, Brucella spp.
KGPKRVGPFAVPKAMSSTASATL

SEQ ID NO: 19547 - protein, 17 aa, Brucella spp.
LATFFKIKGINYSISSA

SEQ ID NO: 19548 - protein, 27 aa, Brucella spp.
AGGCEDLDWTLSVLFDAMGAMSSKYND

SEQ ID NO: 19549 - protein, 19 aa, Brucella spp.
TALARGAKIYGEIVGYGAT

SEQ ID NO: 19550 - protein, 19 aa, Brucella spp.
AIRCMKMALSTVTSKIDYI

SEQ ID NO: 19551 - protein, 23 aa, Brucella spp.
GDAPEIEAIRQIFGAGDVCPPIA

SEQ ID NO: 19552 - protein, 20 aa, Brucella spp.
PEVQVAVLSERIANLTEHFK

SEQ ID NO: 19553 - protein, 21 aa, Brucella spp.
GRPISGWVIFDKPKGMGSTEA

SEQ ID NO: 19554 - protein, 22 aa, Brucella spp.
TEAVSKIKWLFSAEKAGHAGTL

SEQ ID NO: 19555 - protein, 18 aa, Brucella spp.
AKLEAVWPPLPPKDEDGN

SEQ ID NO: 19556 - protein, 23 aa, Brucella spp.
PRRDFSALDALVIDTGAALDCLP

SEQ ID NO: 19557 - protein, 23 aa, Brucella spp.
VTTRGKLLAIGYIEHGQFKPKRV

SEQ ID NO: 19558 - protein, 24 aa, Brucella spp.
VLLSERLVGLFGFVLCEHVPANLG

SEQ ID NO: 19559 - protein, 19 aa, Brucella spp.
RMSPDLKIATCFITPLGSA

SEQ ID NO: 19560 - protein, 19 aa, Brucella spp.
DLKIATCFITPLGSADPQA

SEQ ID NO: 19561 - protein, 18 aa, Brucella spp.
IDALLRFPEVARDLSHDD

SEQ ID NO: 19562 - protein, 18 aa, Brucella spp.
PADRSGMVLNTLSRSEMD

SEQ ID NO: 19563 - protein, 26 aa, Brucella spp.
KISREVTIPETITLQELAQRMAERSV

SEQ ID NO: 19564 - protein, 24 aa, Brucella spp.
RMAERSVDIIKYLMKQGQMMKPGD

SEQ ID NO: 19565 - protein, 19 aa, Brucella spp.
DADTAQLIAEEFGHTVKRV

SEQ ID NO: 19566 - protein, 19 aa, Brucella spp.
QLIAEEFGHTVKRVAESDV

SEQ ID NO: 19567 - protein, 17 aa, Brucella spp.
PPVVTIMGHVDHGKTSL

SEQ ID NO: 19568 - protein, 22 aa, Brucella spp.
IDTPGHAAFTAMRARGAQATDI

SEQ ID NO: 19569 - protein, 20 aa, Brucella spp.
KAAGVPIIVAINKIDKPAAD

SEQ ID NO: 19570 - protein, 17 aa, Brucella spp.
KVRTALLQHEVFVESMG

SEQ ID NO: 19571 - protein, 21 aa, Brucella spp.
DKLLDAVLLQAEMLDLKADPD

SEQ ID NO: 19572 - protein, 17 aa, Brucella spp.
SVATVLIQKGTLHPGDI

SEQ ID NO: 19573 - protein, 33 aa, Brucella spp.
KGTLHPGDILVAGSEWGRVRALVNDRGEHVKEA

SEQ ID NO: 19574 - protein, 26 aa, Brucella spp.
EHVKEAGPAMPVEILGLQGTPQAGDR

SEQ ID NO: 19575 - protein, 25 aa, Brucella spp.
VSGTKEFPLVIKGDVQGSIEAITNA

SEQ ID NO: 19576 - protein, 24 aa, Brucella spp.
SLAEASNAAIIGFNVRANKQARDS

SEQ ID NO: 19577 - protein, 21 aa, Brucella spp.
GIEIRYYNIIYDLIDDVKAAM

SEQ ID NO: 19578 - protein, 24 aa, Brucella spp.
FLGNAEILEVFNITKVGKVAGCRV

SEQ ID NO: 19579 - protein, 26 aa, Brucella spp.
TEGKVERGAGVRLIRDNVVIHEGKLK

SEQ ID NO: 19580 - protein, 19 aa, Brucella spp.
KLKTLKRFKDEVAEVPSGQ

SEQ ID NO: 19581 - protein, 25 aa, Brucella spp.
AEVPSGQECGMAFENYDDIRAGDVI

SEQ ID NO: 19582 - protein, 26 aa, Brucella spp.
HLEGPEIPSFTLFSGEEMDLAFGGGN

SEQ ID NO: 19583 - protein, 18 aa, Brucella spp.
FSGEEMDLAFGGGNVIHA

SEQ ID NO: 19584 - protein, 19 aa, Brucella spp.
GKAAAGFVKRALLLHRYRG

SEQ ID NO: 19585 - protein, 17 aa, Brucella spp.
FVKRALLLHRYRGESAS

SEQ ID NO: 19586 - protein, 23 aa, Brucella spp.
KSGEIKLQRLLEVVENVEDYATQ

SEQ ID NO: 19587 - protein, 23 aa, Brucella spp.
VEDYATQISLFMARDRNPDAQVG

SEQ ID NO: 19588 - protein, 21 aa, Brucella spp.
ADQLPPMDFGRIAAQSAKQVI

SEQ ID NO: 19589 - protein, 25 aa, Brucella spp.
VRRDELIPREAFRYGDRIRAYVYDV

SEQ ID NO: 19590 - protein, 23 aa, Brucella spp.
SRTHPQFMAKLFTMEVPEIYDGI

SEQ ID NO: 19591 - protein, 21 aa, Brucella spp.
LFTMEVPEIYDGIIEIKSVAR

SEQ ID NO: 19592 - protein, 23 aa, Brucella spp.
QNVRLASQLTGWDIDILTEDEES

SEQ ID NO: 19593 - protein, 18 aa, Brucella spp.
RRKELGVADELRELPGMT

SEQ ID NO: 19594 - protein, 21 aa, Brucella spp.
LRELPGMTTAMLVAVGEDGVK

SEQ ID NO: 19595 - protein, 17 aa, Brucella spp.
KTMEDFAGYAVDDLVGW

SEQ ID NO: 19596 - protein, 19 aa, Brucella spp.
DFAGYAVDDLVGWRERKDG

SEQ ID NO: 19597 - protein, 21 aa, Brucella spp.
NHSGVLTPFDLSRVDAEQMVL

SEQ ID NO: 19598 - protein, 25 aa, Brucella spp.
EQMVLAARLKAGWITEEELAAASED

SEQ ID NO: 19599 - protein, 20 aa, Brucella spp.
ARRTGVDPWSVRIACETLAT

SEQ ID NO: 19600 - protein, 18 aa, Brucella spp.
AAGHPLINPSRFRSAARK

SEQ ID NO: 19601 - protein, 18 aa, Brucella spp.
LINPSRFRSAARKAIREI

SEQ ID NO: 19602 - protein, 20 aa, Brucella spp.
GAGDQGIMFGYACRETLDLM

SEQ ID NO: 19603 - protein, 25 aa, Brucella spp.
CRETLDLMPAPIYYSHKILEKLAEA

SEQ ID NO: 19604 - protein, 20 aa, Brucella spp.
RSVVEPYIREALGDLPIAEN

SEQ ID NO: 19605 - protein, 19 aa, Brucella spp.
ALGDLPIAENCNWYINPTG

SEQ ID NO: 19606 - protein, 21 aa, Brucella spp.
IAENCNWYINPTGKFVIGGPD

SEQ ID NO: 19607 - protein, 17 aa, Brucella spp.
INPTGKFVIGGPDGDAG

SEQ ID NO: 19608 - protein, 25 aa, Brucella spp.
LADRCTIQLSYAIGVAQPLSVYVDL

SEQ ID NO: 19609 - protein, 18 aa, Brucella spp.
DLNKPIYAKTSFYGHFGR

SEQ ID NO: 19610 - protein, 25 aa, Brucella spp.
LAAKVGWWFGFGYFVSGLWWIGTAL

SEQ ID NO: 19611 - protein, 18 aa, Brucella spp.
ADQFAWALPLAVLGLPAF

SEQ ID NO: 19612 - protein, 28 aa, Brucella spp.
AWALPLAVLGLPAFLALFYAFAAMIARL

SEQ ID NO: 19613 - protein, 24 aa, Brucella spp.
FALAEWLRTFIFTGFPWNLIGYAA

SEQ ID NO: 19614 - protein, 23 aa, Brucella spp.
VIVWPETAIPYILESTPQALAHI

SEQ ID NO: 19615 - protein, 25 aa, Brucella spp.
HLVPFGEYLPFESFLRGLGLQEVVE

SEQ ID NO: 19616 - protein, 17 aa, Brucella spp.
RSFLPLICYEAIFPDEL

SEQ ID NO: 19617 - protein, 19 aa, Brucella spp.
DGALRMAIAAADQLTLPTM

SEQ ID NO: 19618 - protein, 23 aa, Brucella spp.
LLERGLVERIILSRPAVEAGERL

SEQ ID NO: 19619 - protein, 20 aa, Brucella spp.
PAVEAGERLGFLPGDMKEKV

SEQ ID NO: 19620 - protein, 23 aa, Brucella spp.
AGVIEIAPLAFMRGRTLAHSAVI

SEQ ID NO: 19621 - protein, 23 aa, Brucella spp.
TSMQMKMFLTRLGEGSRMIVTGD

SEQ ID NO: 19622 - protein, 22 aa, Brucella spp.
VVRHPLVAAIVGAYDRDGKQYA

SEQ ID NO: 19623 - protein, 18 aa, Brucella spp.
RKRGVSAFLTVQEGCDKF

SEQ ID NO: 19624 - protein, 21 aa, Brucella spp.
EGCDKFCTFCVVPYTRGSEVS

SEQ ID NO: 19625 - protein, 33 aa, Brucella spp.
EDGREWGLGELLFRLARIPGIAHLRYTTSHPRD

SEQ ID NO: 19626 - protein, 27 aa, Brucella spp.
VRPDMALSGDFIVGFPGETDQDFEDTM

SEQ ID NO: 19627 - protein, 23 aa, Brucella spp.
MVGRSPWLLPVIIDDNKDRVGDI

SEQ ID NO: 19628 - protein, 19 aa, Brucella spp.
QRIHAVAFHHGWSSDDFRS

SEQ ID NO: 19629 - protein, 22 aa, Brucella spp.
SLIAQDTIFGFIARPQGKPNEA

SEQ ID NO: 19630 - protein, 24 aa, Brucella spp.
KPNEACGFVLARLVAGEAEILTIA

SEQ ID NO: 19631 - protein, 23 aa, Brucella spp.
GVRIGVSAARGFALALGVPAIGI

SEQ ID NO: 19632 - protein, 25 aa, Brucella spp.
QAQMPEKPVLVLLDAHRGEIYAQGF

SEQ ID NO: 19633 - protein, 18 aa, Brucella spp.
ALGGRFALVLPEPTAPIG

SEQ ID NO: 19634 - protein, 18 aa, Brucella spp.
LAATIDLALITKQAHWNL

SEQ ID NO: 19635 - protein, 24 aa, Brucella spp.
AHWNLKGPQFIAVHEMLDGFRAEL

SEQ ID NO: 19636 - protein, 20 aa, Brucella spp.
LPLLAGLIAAPFVVTGCTTT

SEQ ID NO: 19637 - protein, 24 aa, Brucella spp.
PRDRECLERAMFFESNRSSPDGLL

SEQ ID NO: 19638 - protein, 27 aa, Brucella spp.
KRHPKLKNAMFFHTAGLTFPYRNMHYV

SEQ ID NO: 19639 - protein, 20 aa, Brucella spp.
TAGLTFPYRNMHYVLVAGGN

SEQ ID NO: 19640 - protein, 19 aa, Brucella spp.
PQEPYNLALAYSPQAPSVP

SEQ ID NO: 19641 - protein, 17 aa, Brucella spp.
YNLALAYSPQAPSVPQE

SEQ ID NO: 19642 - protein, 21 aa, Brucella spp.
PSVPQELSYDVTLPQTVPIPT

SEQ ID NO: 19643 - protein, 23 aa, Brucella spp.
EDEEALSVLLRYNLEAEGYQVDT

SEQ ID NO: 19644 - protein, 24 aa, Brucella spp.
RESVPDLLILDWMLPGVSGIELCR

SEQ ID NO: 19645 - protein, 20 aa, Brucella spp.
ETERLPIIMLTARGEESERV

SEQ ID NO: 19646 - protein, 26 aa, Brucella spp.
LGPTEFRLLEYFMMSPGRVFSRSQLL

SEQ ID NO: 19647 - protein, 25 aa, Brucella spp.
RQPMAVDLREIIGSIRISADLERVG

SEQ ID NO: 19648 - protein, 17 aa, Brucella spp.
SRQPVKLYRGLETLAEL

SEQ ID NO: 19649 - protein, 20 aa, Brucella spp.
KLYRGLETLAELALTQLKEV

SEQ ID NO: 19650 - protein, 19 aa, Brucella spp.
LETLAELALTQLKEVLDAY

SEQ ID NO: 19651 - protein, 23 aa, Brucella spp.
PRNISACTHLLFCAKNIERIGDH

SEQ ID NO: 19652 - protein, 17 aa, Brucella spp.
MRGEKVCVFYGEKQALF

SEQ ID NO: 19653 - protein, 17 aa, Brucella spp.
LDIPEKMVTALIGPSGC

SEQ ID NO: 19654 - protein, 18 aa, Brucella spp.
VVELRARVGMVFQKPNPF

SEQ ID NO: 19655 - protein, 17 aa, Brucella spp.
ARVGMVFQKPNPFPKSI

SEQ ID NO: 19656 - protein, 17 aa, Brucella spp.
SIYENVAYGPRIHGLAR

SEQ ID NO: 19657 - protein, 23 aa, Brucella spp.
QQQRLCIARAIAVSPEVILMDEP

SEQ ID NO: 19658 - protein, 19 aa, Brucella spp.
LRQNFTIVIVTHSMQQAAR

SEQ ID NO: 19659 - protein, 18 aa, Brucella spp.
LYGILAIAVGVFFLCALL

SEQ ID NO: 19660 - protein, 18 aa, Brucella spp.
IGVAASIYLEEFARKNRF

SEQ ID NO: 19661 - protein, 25 aa, Brucella spp.
IVFGLLGLAVFINFFGLPRSASLVG

SEQ ID NO: 19662 - protein, 24 aa, Brucella spp.
ALGETAPLLLIGMVAFVADVPATP

SEQ ID NO: 19663 - protein, 21 aa, Brucella spp.
SRPHYHGWWVFLVSALPALLF

SEQ ID NO: 19664 - protein, 23 aa, Brucella spp.
VSALPALLFLAIWAVGTSVYLDH

SEQ ID NO: 19665 - protein, 20 aa, Brucella spp.
QDYMVPIALYLKKTMALTHT

SEQ ID NO: 19666 - protein, 17 aa, Brucella spp.
NNVERIVLWGLIAASGI

SEQ ID NO: 19667 - protein, 20 aa, Brucella spp.
VERIVLWGLIAASGIAILTT

SEQ ID NO: 19668 - protein, 26 aa, Brucella spp.
SVSPWEFFFGTVWDPRFAAAGSGGQV

SEQ ID NO: 19669 - protein, 22 aa, Brucella spp.
DVQEVRFGYDGIVFATDAKGPD

SEQ ID NO: 19670 - protein, 19 aa, Brucella spp.
LTPEDIYKALAARLVVDGK

SEQ ID NO: 19671 - protein, 24 aa, Brucella spp.
NPNLPDWDIAAYIPGEKHGTREVF

SEQ ID NO: 19672 - protein, 26 aa, Brucella spp.
ASGEYPVSRPLYFYVKKAHLGVIPGL

SEQ ID NO: 19673 - protein, 26 aa, Brucella spp.
VKKAHLGVIPGLKEYVEFFLNDQMIG

SEQ ID NO: 19674 - protein, 19 aa, Brucella spp.
LKEYVEFFLNDQMIGPDGP

SEQ ID NO: 19675 - protein, 17 aa, Brucella spp.
PLAEYGLVPAPDAEREA

SEQ ID NO: 19676 - protein, 20 aa, Brucella spp.
ELFHYTPDWLSMRDGVVSAR

SEQ ID NO: 19677 - protein, 18 aa, Brucella spp.
VTEFPDLMPETLITKDPQ

SEQ ID NO: 19678 - protein, 19 aa, Brucella spp.
NLTSLLEMFGQLFREPFIA

SEQ ID NO: 19679 - protein, 28 aa, Brucella spp.
ARIGPSLKERGFILVGIDVIGDYMTEIN

SEQ ID NO: 19680 - protein, 23 aa, Brucella spp.
KFDEEIRFFKGWIDGPKAVGAIL

SEQ ID NO: 19681 - protein, 20 aa, Brucella spp.
GLPVLEFGPGTGVITKAILK

SEQ ID NO: 19682 - protein, 19 aa, Brucella spp.
FDCIISAVPMLNFPMDRRV

SEQ ID NO: 19683 - protein, 17 aa, Brucella spp.
GARTTPSIIAFTDGDER

SEQ ID NO: 19684 - protein, 17 aa, Brucella spp.
TPSIIAFTDGDERLAGQ

SEQ ID NO: 19685 - protein, 20 aa, Brucella spp.
EGTLFAVKRLIGRRYDDPMV

SEQ ID NO: 19686 - protein, 18 aa, Brucella spp.
YSPSQISAMILQKMKETA

SEQ ID NO: 19687 - protein, 17 aa, Brucella spp.
VTQAVITVPAYFNDAQR

SEQ ID NO: 19688 - protein, 17 aa, Brucella spp.
ITVPAYFNDAQRQATKD

SEQ ID NO: 19689 - protein, 24 aa, Brucella spp.
DAGKIAGLEVLRIINEPTAAALAY

SEQ ID NO: 19690 - protein, 21 aa, Brucella spp.
INEPTAAALAYGLDKSEGKTI

SEQ ID NO: 19691 - protein, 27 aa, Brucella spp.
FLGGEDFDIRLVEYLVAEFKKESGIDL

SEQ ID NO: 19692 - protein, 19 aa, Brucella spp.
TEINLPFITADQTGPKHLA

SEQ ID NO: 19693 - protein, 22 aa, Brucella spp.
GEIDEVVLVGGMTRMPKIQEVV

SEQ ID NO: 19694 - protein, 19 aa, Brucella spp.
VKDVLLLDVTPLSLGIETL

SEQ ID NO: 19695 - protein, 25 aa, Brucella spp.
GIETLGGVFTRLIERNTTIPTKKSQ

SEQ ID NO: 19696 - protein, 19 aa, Brucella spp.
DNQSAVTIRVFQGEREMAA

SEQ ID NO: 19697 - protein, 27 aa, Brucella spp.
MAADNKLLGQFDLVGIPPAPRGVPQIE

SEQ ID NO: 19698 - protein, 17 aa, Brucella spp.
IEVTFDIDANGIVNVSA

SEQ ID NO: 19699 - protein, 18 aa, Brucella spp.
KEHQIRIQASGGLSDADI

SEQ ID NO: 19700 - protein, 24 aa, Brucella spp.
VDDRAAFRAFTIARVLTATRHPDA

SEQ ID NO: 19701 - protein, 17 aa, Brucella spp.
FTIARVLTATRHPDADK

SEQ ID NO: 19702 - protein, 19 aa, Brucella spp.
KIRGVESFGMMCSERELDF

SEQ ID NO: 19703 - protein, 23 aa, Brucella spp.
PVGTSFAAYMGFNDPIIEIGLTP

SEQ ID NO: 19704 - protein, 25 aa, Brucella spp.
DAGNPFCTGFALRMVKGVKNGPSPK

SEQ ID NO: 19705 - protein, 18 aa, Brucella spp.
INALVDITNYVTFDQGRP

SEQ ID NO: 19706 - protein, 17 aa, Brucella spp.
IATKLVLELCGGQPTVL

SEQ ID NO: 19707 - protein, 20 aa, Brucella spp.
PVTEVKRLTGLDVSYEDAFD

SEQ ID NO: 19708 - protein, 25 aa, Brucella spp.
SYEDAFDILKRLGFGVEGDGKTIRA

SEQ ID NO: 19709 - protein, 23 aa, Brucella spp.
GKPELKLANPIAADMSDMRPSLL

SEQ ID NO: 19710 - protein, 19 aa, Brucella spp.
RPSLLPGLLAAAQRNADRG

SEQ ID NO: 19711 - protein, 17 aa, Brucella spp.
EGAGRFWAGNAAPVGVF

SEQ ID NO: 19712 - protein, 20 aa, Brucella spp.
RIQIEAGGPEWLHPGRSGTL

SEQ ID NO: 19713 - protein, 17 aa, Brucella spp.
AGGPEWLHPGRSGTLKL

SEQ ID NO: 19714 - protein, 18 aa, Brucella spp.
LGPKVVLGTFGEFHPDTL

SEQ ID NO: 19715 - protein, 22 aa, Brucella spp.
RTKPALSLSLFQSLKRDYAFVV

SEQ ID NO: 19716 - protein, 18 aa, Brucella spp.
LFQSLKRDYAFVVDAAVE

SEQ ID NO: 19717 - protein, 25 aa, Brucella spp.
DKKLIVGVQVFDIFTGASLGEGKKS

SEQ ID NO: 19718 - protein, 19 aa, Brucella spp.
EPIRIVIPGKTYRMDSDAT

SEQ ID NO: 19719 - protein, 22 aa, Brucella spp.
KFGEGNDWLEILGCGMVHPNVL

SEQ ID NO: 19720 - protein, 30 aa, Brucella spp.
SGYDPEVYQGFAWGMGIGRIAMLKYGMPDL

SEQ ID NO: 19721 - protein, 22 aa, Brucella spp.
HSFISPFLPYPFLRSPKETNPA

SEQ ID NO: 19722 - protein, 32 aa, Brucella spp.
PEAVMPLAVAQARDVWLLFFQITAQARFSKTP

SEQ ID NO: 19723 - protein, 24 aa, Brucella spp.
DVVPELHRIVGLFRFTIAPLRLFR

SEQ ID NO: 19724 - protein, 25 aa, Brucella spp.
GLFRFTIAPLRLFRHVFLGGDGRRL

SEQ ID NO: 19725 - protein, 19 aa, Brucella spp.
QGLTYGRFIDGLAKAGIEI

SEQ ID NO: 19726 - protein, 26 aa, Brucella spp.
SDIAIHEPEAFAALVASAKKALEYLK

SEQ ID NO: 19727 - protein, 17 aa, Brucella spp.
VLCYLAFSIVIRTEEKF

SEQ ID NO: 19728 - protein, 21 aa, Brucella spp.
YCAKVPRFFPKFSLFHDDKEL

SEQ ID NO: 19729 - protein, 24 aa, Brucella spp.
RTFTDGLVFFVAYPFFEFVEYLQN

SEQ ID NO: 19730 - protein, 23 aa, Brucella spp.
EEGDKVKVTLRFRGREMAHQELG

SEQ ID NO: 19731 - protein, 18 aa, Brucella spp.
HQELGMKLLQRVKEDTVE

SEQ ID NO: 19732 - protein, 24 aa, Brucella spp.
WLSIRYRMPIIAAWSTPGLALIGA

SEQ ID NO: 19733 - protein, 30 aa, Brucella spp.
VSIDPAFVLPLVALFFLIRLFGPSLAVIAV

SEQ ID NO: 19734 - protein, 24 aa, Brucella spp.
LPAPEISTLTLVWPQFHTGAMIGI

SEQ ID NO: 19735 - protein, 17 aa, Brucella spp.
FHTGAMIGIAVPLYLVT

SEQ ID NO: 19736 - protein, 25 aa, Brucella spp.
PTSACLRITGLFSLLSAPLGASTTN

SEQ ID NO: 19737 - protein, 17 aa, Brucella spp.
WLTGPVYAAIYVVFALF

SEQ ID NO: 19738 - protein, 24 aa, Brucella spp.
MRNCCKSESFNFGTTGNAAFDDWR

SEQ ID NO: 19739 - protein, 17 aa, Brucella spp.
FNFGTTGNAAFDDWRRE

SEQ ID NO: 19740 - protein, 20 aa, Brucella spp.
VRAGIKIPIRGVAHLIVHQP

SEQ ID NO: 19741 - protein, 27 aa, Brucella spp.
GSCTSDGVLSFSWRIGMAPPPVINYLV

SEQ ID NO: 19742 - protein, 21 aa, Brucella spp.
IEMNHGPKFWKLCQELCPDTE

SEQ ID NO: 19743 - protein, 25 aa, Brucella spp.
SDLYLEGLAPWLIFTGRSGRGTDKL

SEQ ID NO: 19744 - protein, 20 aa, Brucella spp.
LEVMEAYDFLIEQGFDGHPV

SEQ ID NO: 19745 - protein, 23 aa, Brucella spp.
GGATHIGFIFFPKSPRHITPDAA

SEQ ID NO: 19746 - protein, 24 aa, Brucella spp.
KERYNLPVMKAFSIREAGDLEAIA

SEQ ID NO: 19747 - protein, 17 aa, Brucella spp.
PYRGIADRFLFDAKPPK

SEQ ID NO: 19748 - protein, 17 aa, Brucella spp.
IADRFLFDAKPPKGSEL

SEQ ID NO: 19749 - protein, 31 aa, Brucella spp.
GSELPGGNGISFDWNLLAALDADIDYMLSGG

SEQ ID NO: 19750 - protein, 22 aa, Brucella spp.
PDEEGMFGIFGGRFVAETLMPL

SEQ ID NO: 19751 - protein, 23 aa, Brucella spp.
RFVAETLMPLILELQQAYETAKN

SEQ ID NO: 19752 - protein, 24 aa, Brucella spp.
PEFKAELNALSTFYAGRPSKLYYA

SEQ ID NO: 19753 - protein, 22 aa, Brucella spp.
LSKHLGGAKIYFKREDLNHTGS

SEQ ID NO: 19754 - protein, 19 aa, Brucella spp.
INNCLGQILLAKRMGKTRI

SEQ ID NO: 19755 - protein, 27 aa, Brucella spp.
ATVAARFGLPCIVYVGASDVERQKPNV

SEQ ID NO: 19756 - protein, 17 aa, Brucella spp.
KPNVFRMKLLGAEVKPV

SEQ ID NO: 19757 - protein, 17 aa, Brucella spp.
GRLPDVIVAAVGGGSNA

SEQ ID NO: 19758 - protein, 19 aa, Brucella spp.
IGLFHPFLDDASVKIVGVE

SEQ ID NO: 19759 - protein, 17 aa, Brucella spp.
GPEHSWLKDSGRVDYVP

SEQ ID NO: 19760 - protein, 19 aa, Brucella spp.
ILDNEALDAFQLCTRTEGI

SEQ ID NO: 19761 - protein, 25 aa, Brucella spp.
HQGEESLWLLLHWWLEGGIATRMLW

SEQ ID NO: 19762 - protein, 27 aa, Brucella spp.
VEFMPAQPLLMACVWELGIIDFERRAW

SEQ ID NO: 19763 - protein, 24 aa, Brucella spp.
LKAEGRPALVTYFMGGDPDLETAL

SEQ ID NO: 19764 - protein, 18 aa, Brucella spp.
AGADVIELGMPFSDPMAD

SEQ ID NO: 19765 - protein, 22 aa, Brucella spp.
VMMGYYNLIYIYGVERFLTDAK

SEQ ID NO: 19766 - protein, 18 aa, Brucella spp.
MDAELCIPAMKAGINFIR

SEQ ID NO: 19767 - protein, 22 aa, Brucella spp.
LCIPAMKAGINFIRLTTPTTDD

SEQ ID NO: 19768 - protein, 25 aa, Brucella spp.
KKSTDLPICVGFGVKTPEQAAAIAT

SEQ ID NO: 19769 - protein, 24 aa, Brucella spp.
EKAIELKRPLVLFASSGGARMQEG

SEQ ID NO: 19770 - protein, 22 aa, Brucella spp.
MLKEAGLPYIVVLTNPTTGGVT

SEQ ID NO: 19771 - protein, 18 aa, Brucella spp.
IHIAEPGALIGFAGPRVI

SEQ ID NO: 19772 - protein, 21 aa, Brucella spp.
AEPGALIGFAGPRVIEQTIRE

SEQ ID NO: 19773 - protein, 20 aa, Brucella spp.
RLELKATIARLLKIMTKQPA

SEQ ID NO: 19774 - protein, 17 aa, Brucella spp.
LKLPPVIHIAGTNGKGS

SEQ ID NO: 19775 - protein, 27 aa, Brucella spp.
QHITVFEILTAVAFVLFSEHPADAVIM

SEQ ID NO: 19776 - protein, 21 aa, Brucella spp.
PEPAVSLIMPVSIDHQAYLGD

SEQ ID NO: 19777 - protein, 23 aa, Brucella spp.
IIKKNCPVVIGFQPFDTAREVLV

SEQ ID NO: 19778 - protein, 21 aa, Brucella spp.
ERNARPLFLITGMINTKDPVG

SEQ ID NO: 19779 - protein, 19 aa, Brucella spp.
FAGMARHVFTVPIPSSDAG

SEQ ID NO: 19780 - protein, 25 aa, Brucella spp.
ADEAPPRILIGGSLYLAGEVLRDND

SEQ ID NO: 19781 - protein, 26 aa, Brucella spp.
VKVLPDLVGEPFFILNADTFWVGDEA

SEQ ID NO: 19782 - protein, 20 aa, Brucella spp.
AEPNLVRLAETWDDARMDIL

SEQ ID NO: 19783 - protein, 18 aa, Brucella spp.
ARMDILLMTARLDQETGY

SEQ ID NO: 19784 - protein, 25 aa, Brucella spp.
EAATLRFGEDFALALQKGDFITLSG

SEQ ID NO: 19785 - protein, 18 aa, Brucella spp.
LRLPVAHADLYRLSTPEE

SEQ ID NO: 19786 - protein, 23 aa, Brucella spp.
EQGEGFLPQATFAVMLSHEGAGR

SEQ ID NO: 19787 - protein, 17 aa, Brucella spp.
HLAENILAFAAIDGLLA

SEQ ID NO: 19788 - protein, 18 aa, Brucella spp.
AENILAFAAIDGLLAGQG

SEQ ID NO: 19789 - protein, 19 aa, Brucella spp.
QMRGSDLDAGFLILENLGT

SEQ ID NO: 19790 - protein, 18 aa, Brucella spp.
SDLDAGFLILENLGTEGV

SEQ ID NO: 19791 - protein, 17 aa, Brucella spp.
GRFLAHLHGVRWPDHAP

SEQ ID NO: 19792 - protein, 26 aa, Brucella spp.
LHGVRWPDHAPVAFYPDHVIAPFDRD

SEQ ID NO: 19793 - protein, 20 aa, Brucella spp.
IEVSLVGQWYAPRMMGRPLN

SEQ ID NO: 19794 - protein, 21 aa, Brucella spp.
RDYHSPNLFWLAGAQGKDKIG

SEQ ID NO: 19795 - protein, 20 aa, Brucella spp.
RNAKLLGLFVRLDERDGKPA

SEQ ID NO: 19796 - protein, 25 aa, Brucella spp.
VLKHPVMAPVAAWFKALGLMQEGTV

SEQ ID NO: 19797 - protein, 22 aa, Brucella spp.
AETEMPGLMAAREEFGKSQPLK

SEQ ID NO: 19798 - protein, 23 aa, Brucella spp.
ETLKVLGAEVRWASCNIFSTQDH

SEQ ID NO: 19799 - protein, 18 aa, Brucella spp.
GDATMYILIGARAEAGED

SEQ ID NO: 19800 - protein, 21 aa, Brucella spp.
LQKKGLLPFPAINVNDSVTKS

SEQ ID NO: 19801 - protein, 23 aa, Brucella spp.
VKVTEVDPICALQAAMDGFEVVT

SEQ ID NO: 19802 - protein, 18 aa, Brucella spp.
MKDMCIVGNIGHFDNEIQ

SEQ ID NO: 19803 - protein, 23 aa, Brucella spp.
NEIQVAALRNLKWTNVKPQVDLI

SEQ ID NO: 19804 - protein, 28 aa, Brucella spp.
QVDLIEFPDGKRLILLSEGRLLNLGNAT

SEQ ID NO: 19805 - protein, 24 aa, Brucella spp.
ATGHPSFVMSASFTNQVLGQIELF

SEQ ID NO: 19806 - protein, 25 aa, Brucella spp.
PDNAVSRSFEIVNKRGLHARASAKF

SEQ ID NO: 19807 - protein, 18 aa, Brucella spp.
IVNKRGLHARASAKFVQL

SEQ ID NO: 19808 - protein, 18 aa, Brucella spp.
VMEAGRIEVIAGVNLPML

SEQ ID NO: 19809 - protein, 29 aa, Brucella spp.
GRIEVIAGVNLPMLIKLSSVRISGDIKTA

SEQ ID NO: 19810 - protein, 18 aa, Brucella spp.
AGGVEIRGAGLFRIPYRV

SEQ ID NO: 19811 - protein, 26 aa, Brucella spp.
VEIRGAGLFRIPYRVATPLDLVVLLV

SEQ ID NO: 19812 - protein, 21 aa, Brucella spp.
YPGKERWIFEEVSLPRLLLPA

SEQ ID NO: 19813 - protein, 22 aa, Brucella spp.
FEEVSLPRLLLPALSANGDSNA

SEQ ID NO: 19814 - protein, 18 aa, Brucella spp.
RRQRSVFLRRFLSPLRKF

SEQ ID NO: 19815 - protein, 25 aa, Brucella spp.
FLSPLRKFLGQYLFSSLTRRILFLN

SEQ ID NO: 19816 - protein, 17 aa, Brucella spp.
SLTRRILFLNLAALAVL

SEQ ID NO: 19817 - protein, 29 aa, Brucella spp.
ETPALWERIGSWLSRLFYGGGLPLYQEQP

SEQ ID NO: 19818 - protein, 18 aa, Brucella spp.
LYQEQPGGNGLAYQEIVK

SEQ ID NO: 19819 - protein, 17 aa, Brucella spp.
PGGNGLAYQEIVKALSG

SEQ ID NO: 19820 - protein, 21 aa, Brucella spp.
GELIVSVAVPIQRSRAILGVL

SEQ ID NO: 19821 - protein, 21 aa, Brucella spp.
PIQRSRAILGVLLLSTEGDDI

SEQ ID NO: 19822 - protein, 20 aa, Brucella spp.
AERMAVFRVFGVVSAVMVIL

SEQ ID NO: 19823 - protein, 22 aa, Brucella spp.
LMARPPNLAIFDIKMPRMDGME

SEQ ID NO: 19824 - protein, 24 aa, Brucella spp.
DIKMPRMDGMELLRRLRQKSDLPV

SEQ ID NO: 19825 - protein, 19 aa, Brucella spp.
QKSDLPVIFLTSKDDEIDE

SEQ ID NO: 19826 - protein, 18 aa, Brucella spp.
DELFGLKMGADDFITKPF

SEQ ID NO: 19827 - protein, 17 aa, Brucella spp.
GEPVTLTVTEFLILHSL

SEQ ID NO: 19828 - protein, 25 aa, Brucella spp.
VTLTVTEFLILHSLAQRPGVVKSRD

SEQ ID NO: 19829 - protein, 18 aa, Brucella spp.
PEAFELLYADFIEHAKGR

SEQ ID NO: 19830 - protein, 24 aa, Brucella spp.
VITEYAWHSLFIRNLLIRPSQEAL

SEQ ID NO: 19831 - protein, 24 aa, Brucella spp.
YVPEMTIIDLPSFKADPERYGVRT

SEQ ID NO: 19832 - protein, 27 aa, Brucella spp.
VRTETVIAVDLTRKIVLIGGTSYAGEM

SEQ ID NO: 19833 - protein, 25 aa, Brucella spp.
EATFSTCFGAPFMPRHPSEYGNLLR

SEQ ID NO: 19834 - protein, 21 aa, Brucella spp.
EHKVDCWLVNTGWTGGAYGVG

SEQ ID NO: 19835 - protein, 19 aa, Brucella spp.
VGKRMPIKATRALLAAALD

SEQ ID NO: 19836 - protein, 18 aa, Brucella spp.
NNAEFRIDPNFGFAVPVE

SEQ ID NO: 19837 - protein, 22 aa, Brucella spp.
RIDPNFGFAVPVEVPGVESSIL

SEQ ID NO: 19838 - protein, 24 aa, Brucella spp.
VNKVSTAVQLRFHAARSGLPEDIL

SEQ ID NO: 19839 - protein, 26 aa, Brucella spp.
RSGLPEDILSRLFKLAGQKGTKDGDI

SEQ ID NO: 19840 - protein, 20 aa, Brucella spp.
DARERLLALIAKAAEPPPPP

SEQ ID NO: 19841 - protein, 23 aa, Brucella spp.
PYRFFSAQEWAAFRADTPLTLTY

SEQ ID NO: 19842 - protein, 18 aa, Brucella spp.
VRRIYLSLSRLLYAHVEA

SEQ ID NO: 19843 - protein, 20 aa, Brucella spp.
EESYKTPFIIGVAGSVAVGK

SEQ ID NO: 19844 - protein, 27 aa, Brucella spp.
KGFPESYDIGAVLRFLSAIKAGMSRVR

SEQ ID NO: 19845 - protein, 17 aa, Brucella spp.
QCFMPLTVGGGVRQVAD

SEQ ID NO: 19846 - protein, 18 aa, Brucella spp.
AASIFHFGTYTIGEAKRY

SEQ ID NO: 19847 - protein, 22 aa, Brucella spp.
QGFEWLHVVDLNGAFAGESVNG

SEQ ID NO: 19848 - protein, 25 aa, Brucella spp.
TLAHIENWLSRGLRRVILGTVAVRD

SEQ ID NO: 19849 - protein, 18 aa, Brucella spp.
CKAFPGQVAVGIDAKGGK

SEQ ID NO: 19850 - protein, 17 aa, Brucella spp.
DRDGVLAGINWDSTLAL

SEQ ID NO: 19851 - protein, 18 aa, Brucella spp.
VLAGINWDSTLALAEAVS

SEQ ID NO: 19852 - protein, 18 aa, Brucella spp.
AVSIPVIASGGLASMEDI

SEQ ID NO: 19853 - protein, 25 aa, Brucella spp.
KKARPFLGICVGMQLMSERGLEKTV

SEQ ID NO: 19854 - protein, 19 aa, Brucella spp.
KTVTNGLGWIAGDVREMVP

SEQ ID NO: 19855 - protein, 31 aa, Brucella spp.
RDGFSILALVFPFVWLLMQRLWFEAFAVLGI

SEQ ID NO: 19856 - protein, 24 aa, Brucella spp.
QRLWFEAFAVLGITILLGLAGTSL

SEQ ID NO: 19857 - protein, 21 aa, Brucella spp.
AKRAVAIALRNRWRRQQLEGQ

SEQ ID NO: 19858 - protein, 18 aa, Brucella spp.
EEVMPKNILMIGPTGVGK

SEQ ID NO: 19859 - protein, 20 aa, Brucella spp.
SRRLAKLAGAPFVKVEATKF

SEQ ID NO: 19860 - protein, 18 aa, Brucella spp.
RDLVEIAITLVREKRRED

SEQ ID NO: 19861 - protein, 17 aa, Brucella spp.
ANIGVLNISDMLGKAMG

SEQ ID NO: 19862 - protein, 25 aa, Brucella spp.
LRVSEDEGIVFIDEIDKIAAREGGS

SEQ ID NO: 19863 - protein, 18 aa, Brucella spp.
TDHILFITSGAFHVSKPS

SEQ ID NO: 19864 - protein, 26 aa, Brucella spp.
ELQGRLPIRVELSALTREDFRRILTE

SEQ ID NO: 19865 - protein, 29 aa, Brucella spp.
PNAKPLRTFAGIALAFFLASQSAHAVTVV

SEQ ID NO: 19866 - protein, 21 aa, Brucella spp.
AYGIDPIHIIGAIVGEHTYNV

SEQ ID NO: 19867 - protein, 31 aa, Brucella spp.
QFIKRPEFAACLRFKDSYSLWTCRENVWNAD

SEQ ID NO: 19868 - protein, 25 aa, Brucella spp.
PNNRFSAVFFQPFYAGQTFGLGQIN

SEQ ID NO: 19869 - protein, 23 aa, Brucella spp.
PMLPQENYYGWLVNSKLDELKAL

SEQ ID NO: 19870 - protein, 17 aa, Brucella spp.
PEALPDFKALMAEEQEK

SEQ ID NO: 19871 - protein, 23 aa, Brucella spp.
QNEAHGLLYGFLVNAHARGLRHV

SEQ ID NO: 19872 - protein, 26 aa, Brucella spp.
LRQAVPHWFSTPLFRLLVSAYEDAAR

SEQ ID NO: 19873 - protein, 17 aa, Brucella spp.
DDQALAFAAFRRSADYA

SEQ ID NO: 19874 - protein, 19 aa, Brucella spp.
SFEALKPIFAAARALDRPD

SEQ ID NO: 19875 - protein, 18 aa, Brucella spp.
PEQGKGFVTGFYEPEIEA

SEQ ID NO: 19876 - protein, 21 aa, Brucella spp.
NRPAGLDPSFAFARQTESGLE

SEQ ID NO: 19877 - protein, 18 aa, Brucella spp.
APTLCAFGGEPFARLMIA

SEQ ID NO: 19878 - protein, 23 aa, Brucella spp.
LAMPFIEIAGFIVVGSYIGVFAT

SEQ ID NO: 19879 - protein, 19 aa, Brucella spp.
LRVQGIGLLQRIRTETAAG

SEQ ID NO: 19880 - protein, 19 aa, Brucella spp.
ILLFIPFVRDIVWEKFVRG

SEQ ID NO: 19881 - protein, 17 aa, Brucella spp.
FVRDIVWEKFVRGRMVV

SEQ ID NO: 19882 - protein, 17 aa, Brucella spp.
ATFPGTVENGIVNREKL

SEQ ID NO: 19883 - protein, 18 aa, Brucella spp.
KKLEAVVHPLVREEEDAF

SEQ ID NO: 19884 - protein, 21 aa, Brucella spp.
ALVDIPLLFETGAEKRVDKVV

SEQ ID NO: 19885 - protein, 21 aa, Brucella spp.
TQEKLKAILVRQIPDAEKRSR

SEQ ID NO: 19886 - protein, 24 aa, Brucella spp.
AIIFPIVFVLGFFAIFWLRSKGQN

SEQ ID NO: 19887 - protein, 19 aa, Brucella spp.
ENGRIAVGDFTLFDAQKGI

SEQ ID NO: 19888 - protein, 25 aa, Brucella spp.
KRRIGYVFQDARLFAYMSVKRNLTY

SEQ ID NO: 19889 - protein, 23 aa, Brucella spp.
SFDEVVALLGIGHLLDRRPSTLS

SEQ ID NO: 19890 - protein, 25 aa, Brucella spp.
IARKIPEAISIRNLLPVTVTGIERG

SEQ ID NO: 19891 - protein, 20 aa, Brucella spp.
EGPNAHVFLDFRGRRLGARL

SEQ ID NO: 19892 - protein, 24 aa, Brucella spp.
IIIALPLAFLVGWLLARFHFPGKS

SEQ ID NO: 19893 - protein, 24 aa, Brucella spp.
LQEWLGLSFAFRWTGAALAAGVMA

SEQ ID NO: 19894 - protein, 17 aa, Brucella spp.
DARELLSAGRFAMGDPS

SEQ ID NO: 19895 - protein, 17 aa, Brucella spp.
RELLSAGRFAMGDPSNV

SEQ ID NO: 19896 - protein, 19 aa, Brucella spp.
LVEAYRFPADSHAPILYPA

SEQ ID NO: 19897 - protein, 24 aa, Brucella spp.
FPADSHAPILYPAALLKKNESDAA

SEQ ID NO: 19898 - protein, 21 aa, Brucella spp.
NESDAARTFLAFLESDAGQAI

SEQ ID NO: 19899 - protein, 18 aa, Brucella spp.
RNLEAIVMRMGYRTILAD

SEQ ID NO: 19900 - protein, 20 aa, Brucella spp.
EAIVMRMGYRTILADGGVSA

SEQ ID NO: 19901 - protein, 19 aa, Brucella spp.
RKDIVLVLLDLTMPDMDGL

SEQ ID NO: 19902 - protein, 24 aa, Brucella spp.
TMPDMDGLTVLSRMRAAGVAVPVI

SEQ ID NO: 19903 - protein, 17 aa, Brucella spp.
DFMIKPLIFERVQVSVA

SEQ ID NO: 19904 - protein, 20 aa, Brucella spp.
PEMERVMVLARRAAALDAPL

SEQ ID NO: 19905 - protein, 20 aa, Brucella spp.
LPHHAQLRLFTAMQSGQYES

SEQ ID NO: 19906 - protein, 27 aa, Brucella spp.
RFHAGLYHLLGSFSIAMPPLRERVEDI

SEQ ID NO: 19907 - protein, 20 aa, Brucella spp.
VEDISILVHQFAVRFASEER

SEQ ID NO: 19908 - protein, 23 aa, Brucella spp.
PHLLERLKAYQWPGNVRELKNAV

SEQ ID NO: 19909 - protein, 19 aa, Brucella spp.
VARRLGIGRTTLYRKLKEY

SEQ ID NO: 19910 - protein, 24 aa, Brucella spp.
LGNLPEWNLADLYPAPDSPQLASD

SEQ ID NO: 19911 - protein, 20 aa, Brucella spp.
REFEALSELMGRIGSYAGLY

SEQ ID NO: 19912 - protein, 17 aa, Brucella spp.
LMGRIGSYAGLYYYGDT

SEQ ID NO: 19913 - protein, 17 aa, Brucella spp.
IGSYAGLYYYGDTTDPK

SEQ ID NO: 19914 - protein, 19 aa, Brucella spp.
DASTPLIFFTLELNCIDDT

SEQ ID NO: 19915 - protein, 17 aa, Brucella spp.
IGHYRPWLTDLRMDKPY

SEQ ID NO: 19916 - protein, 23 aa, Brucella spp.
PLPETPQALIPWDEARETVLSAY

SEQ ID NO: 19917 - protein, 20 aa, Brucella spp.
PSAHPYVLLNYMGKPRDVMT

SEQ ID NO: 19918 - protein, 24 aa, Brucella spp.
ASVFGEMLTFRLLLERTRDKRERK

SEQ ID NO: 19919 - protein, 30 aa, Brucella spp.
PGYETFWTYIPHFIHSPFYVYAYAFGDCLV

SEQ ID NO: 19920 - protein, 25 aa, Brucella spp.
TKHHKELLAPFGLDASDPGFWNKGL

SEQ ID NO: 19921 - protein, 25 aa, Brucella spp.
PEGRKTPLLCFGVFDGPSDEQLHVR

SEQ ID NO: 19922 - protein, 20 aa, Brucella spp.
QGNLTFPVTAQWGGDPLILF

SEQ ID NO: 19923 - protein, 27 aa, Brucella spp.
FPVTAQWGGDPLILFNMLAKRQPVRYA

SEQ ID NO: 19924 - protein, 23 aa, Brucella spp.
KSGLHLRAVFAALFPCGSITGAP

SEQ ID NO: 19925 - protein, 20 aa, Brucella spp.
AEGNYLYLSPQLVEINMRSI

SEQ ID NO: 19926 - protein, 31 aa, Brucella spp.
LSDRRVIEWSRLIWYPILYGIVLNTRPRRSG

SEQ ID NO: 19927 - protein, 25 aa, Brucella spp.
LQQGCERIVIFPLYPQYSATTTATV

SEQ ID NO: 19928 - protein, 24 aa, Brucella spp.
FEALMKKRFMPAIRTVPSYEAEPV

SEQ ID NO: 19929 - protein, 23 aa, Brucella spp.
SYEAEPVYIDALARSVEKHLATL

SEQ ID NO: 19930 - protein, 18 aa, Brucella spp.
LETTRLLRERLGLGEDEM

SEQ ID NO: 19931 - protein, 17 aa, Brucella spp.
LILVALVLAALIASIKT

SEQ ID NO: 19932 - protein, 21 aa, Brucella spp.
TVPQGYNYTIERFGRYTRTLN

SEQ ID NO: 19933 - protein, 25 aa, Brucella spp.
RTLNPGLNLIVPFFDRVGARLNMME

SEQ ID NO: 19934 - protein, 24 aa, Brucella spp.
RVVDEAAHPWGIKITRVEIKDINP

SEQ ID NO: 19935 - protein, 20 aa, Brucella spp.
KAVFPVAGLGTRFLPATKSI

SEQ ID NO: 19936 - protein, 18 aa, Brucella spp.
AGLGTRFLPATKSIPKEM

SEQ ID NO: 19937 - protein, 22 aa, Brucella spp.
REAGIEHLIFVTGRNKAVIEDY

SEQ ID NO: 19938 - protein, 22 aa, Brucella spp.
RQQVPLGLGHAVWCARELVGNE

SEQ ID NO: 19939 - protein, 17 aa, Brucella spp.
WCARELVGNEPFALLLP

SEQ ID NO: 19940 - protein, 19 aa, Brucella spp.
VGNEPFALLLPDMVMQSKK

SEQ ID NO: 19941 - protein, 25 aa, Brucella spp.
KAGFIEANVAFALWREDIRPSVEGS

SEQ ID NO: 19942 - protein, 21 aa, Brucella spp.
GFNPYAIGVVGGRLVRQPVSL

SEQ ID NO: 19943 - protein, 22 aa, Brucella spp.
EAKGWNFSLGIAQVNRYNLPKY

SEQ ID NO: 19944 - protein, 23 aa, Brucella spp.
GSKILEDCYRRAIVKMPGQEQGA

SEQ ID NO: 19945 - protein, 20 aa, Brucella spp.
PGQEQGALRAAFSCYYAGNF

SEQ ID NO: 19946 - protein, 25 aa, Brucella spp.
LRAAFSCYYAGNFTGGFKTKPGSPS

SEQ ID NO: 19947 - protein, 17 aa, Brucella spp.
TTKPIVVVPMIRKTPDA

SEQ ID NO: 19948 - protein, 20 aa, Brucella spp.
AQFFTGWTYWLCWIVTAVAE

SEQ ID NO: 19949 - protein, 17 aa, Brucella spp.
WTYWLCWIVTAVAEVVA

SEQ ID NO: 19950 - protein, 20 aa, Brucella spp.
EVVAVPGYVSFWFPHLAPWI

SEQ ID NO: 19951 - protein, 19 aa, Brucella spp.
GYVSFWFPHLAPWIPALGL

SEQ ID NO: 19952 - protein, 17 aa, Brucella spp.
FPHLAPWIPALGLITIL

SEQ ID NO: 19953 - protein, 27 aa, Brucella spp.
VRNFGEIEFWFALIKIITIIGLIITGI

SEQ ID NO: 19954 - protein, 22 aa, Brucella spp.
INNIPIRIVLFYIGALFVIITV

SEQ ID NO: 19955 - protein, 18 aa, Brucella spp.
MPGGRASVVMVFIFFAFV

SEQ ID NO: 19956 - protein, 25 aa, Brucella spp.
GRASVVMVFIFFAFVLWALTQEPDT

SEQ ID NO: 19957 - protein, 17 aa, Brucella spp.
AAMKVTPLWFVLLGIAY

SEQ ID NO: 19958 - protein, 19 aa, Brucella spp.
VTPLWFVLLGIAYWVMKLK

SEQ ID NO: 19959 - protein, 18 aa, Brucella spp.
MDCGIPYCHGPTGCPVHN

SEQ ID NO: 19960 - protein, 17 aa, Brucella spp.
HNQIPDWNDLVYNNNWD

SEQ ID NO: 19961 - protein, 19 aa, Brucella spp.
LTNNFPEFTGRICPAPCEE

SEQ ID NO: 19962 - protein, 24 aa, Brucella spp.
RESRPGGLLRYGIPDFKMEKHLID

SEQ ID NO: 19963 - protein, 24 aa, Brucella spp.
EKEDKLSVWPYWATKMRTSSSQAE

SEQ ID NO: 19964 - protein, 34 aa, Brucella spp.
EKRRPIAGTEFFIKADLAFIAIGFAGPVEDSVVK

SEQ ID NO: 19965 - protein, 21 aa, Brucella spp.
IRRGQSLVVWAIREGRQAAHA

SEQ ID NO: 19966 - protein, 18 aa, Brucella spp.
HDACGVGFIAHMKGRKSH

SEQ ID NO: 19967 - protein, 17 aa, Brucella spp.
MGDGAGILVQIPDRFFR

SEQ ID NO: 19968 - protein, 21 aa, Brucella spp.
DGAGILVQIPDRFFREEMARQ

SEQ ID NO: 19969 - protein, 24 aa, Brucella spp.
DLPQPGHYGVGYIFMPRDPDLRAH

SEQ ID NO: 19970 - protein, 24 aa, Brucella spp.
VIAAEGQTFIGFREVPVDNSSLSK

SEQ ID NO: 19971 - protein, 27 aa, Brucella spp.
KAPHIAATEPFHMQVFIGRSPMLETDD

SEQ ID NO: 19972 - protein, 17 aa, Brucella spp.
RTVVYKGMFLAYQVGAY

SEQ ID NO: 19973 - protein, 23 aa, Brucella spp.
LKDPRFESAVALVHQRFSTNTFP

SEQ ID NO: 19974 - protein, 25 aa, Brucella spp.
HQRFSTNTFPSWRLAHPYRMVAHNG

SEQ ID NO: 19975 - protein, 25 aa, Brucella spp.
ELFGNDISKLWPISYEGQSDTACFD

SEQ ID NO: 19976 - protein, 18 aa, Brucella spp.
LAHAMMMLIPEAWSGNKL

SEQ ID NO: 19977 - protein, 17 aa, Brucella spp.
MLIPEAWSGNKLMSDER

SEQ ID NO: 19978 - protein, 25 aa, Brucella spp.
ALMEPWDGPAAVAFTDGRQIGAMLD

SEQ ID NO: 19979 - protein, 24 aa, Brucella spp.
PVDEKKIVRKWRLQPGRMLLIDME

SEQ ID NO: 19980 - protein, 20 aa, Brucella spp.
KWRLQPGRMLLIDMEEGRII

SEQ ID NO: 19981 - protein, 25 aa, Brucella spp.
DPIREELVMSLVSFIGPRPNIFDLV

SEQ ID NO: 19982 - protein, 22 aa, Brucella spp.
GPDRIPIPALLATAAVHHHLIR

SEQ ID NO: 19983 - protein, 20 aa, Brucella spp.
REVHHFACLAGYGAEAINPY

SEQ ID NO: 19984 - protein, 22 aa, Brucella spp.
AEAINPYLAFDTLLDMHRRREF

SEQ ID NO: 19985 - protein, 18 aa, Brucella spp.
VMSKMGISTYQSYCGAQI

SEQ ID NO: 19986 - protein, 17 aa, Brucella spp.
AQIFDAVGVRTDFVDKF

SEQ ID NO: 19987 - protein, 24 aa, Brucella spp.
VGVRTDFVDKFFFGTATTIEGVGL

SEQ ID NO: 19988 - protein, 18 aa, Brucella spp.
NALEVGGEYAYRMRGEAH

SEQ ID NO: 19989 - protein, 17 aa, Brucella spp.
VIGALLGADEFGFSTAP

SEQ ID NO: 19990 - protein, 27 aa, Brucella spp.
LGADEFGFSTAPLIAAGCIMMRKCHLN

SEQ ID NO: 19991 - protein, 26 aa, Brucella spp.
FKGTPEHVINFFFYLAEEVRALLAQM

SEQ ID NO: 19992 - protein, 25 aa, Brucella spp.
AEEVRALLAQMGFTRLEQIIGETEL

SEQ ID NO: 19993 - protein, 24 aa, Brucella spp.
HWKAKGLDFSRIFYKPEAEKHEIY

SEQ ID NO: 19994 - protein, 18 aa, Brucella spp.
KGLPEDTISVTLRGTAGQ

SEQ ID NO: 19995 - protein, 23 aa, Brucella spp.
GTAGQSFGAFLARGISFELIGDG

SEQ ID NO: 19996 - protein, 23 aa, Brucella spp.
RPKFVKVMPVEYRRALEEMERMQ

SEQ ID NO: 19997 - protein, 22 aa, Brucella spp.
NELFEREVAVFFVGTGTAANSL

SEQ ID NO: 19998 - protein, 24 aa, Brucella spp.
TPAEMTWKLGVDIVSFGGTKNGCW

SEQ ID NO: 19999 - protein, 18 aa, Brucella spp.
WCAEALVFMDPARAKDLP

SEQ ID NO: 20000 - protein, 18 aa, Brucella spp.
AKDLPFIRKRAAQLFSKT

SEQ ID NO: 20001 - protein, 26 aa, Brucella spp.
MRLAWKPEANEVFAIMKQSVYDRLRD

SEQ ID NO: 20002 - protein, 20 aa, Brucella spp.
GEGEIFARFVTSFANTEEEV

SEQ ID NO: 20003 - protein, 20 aa, Brucella spp.
LYRSTVGFDRLFTMLDSLAS

SEQ ID NO: 20004 - protein, 17 aa, Brucella spp.
VGFDRLFTMLDSLASPE

SEQ ID NO: 20005 - protein, 17 aa, Brucella spp.
FDRLFTMLDSLASPEGN

SEQ ID NO: 20006 - protein, 19 aa, Brucella spp.
ENAYRITMAVAGFSENELE

SEQ ID NO: 20007 - protein, 20 aa, Brucella spp.
RAFERRFQLADFVEVSGASL

SEQ ID NO: 20008 - protein, 19 aa, Brucella spp.
AADNGLRVQIQYYDDDGYR

SEQ ID NO: 20009 - protein, 18 aa, Brucella spp.
SGRRVVVMVDAYNGNIIG

SEQ ID NO: 20010 - protein, 18 aa, Brucella spp.
ESRPCRGTVIVLQGRNEF

SEQ ID NO: 20011 - protein, 20 aa, Brucella spp.
PCRGTVIVLQGRNEFIENYY

SEQ ID NO: 20012 - protein, 25 aa, Brucella spp.
GIVLPDCPPPFFILAHSAGALVALS

SEQ ID NO: 20013 - protein, 17 aa, Brucella spp.
NVRRITAALRWIGLGRI

SEQ ID NO: 20014 - protein, 21 aa, Brucella spp.
RRITAALRWIGLGRIYAAGGR

SEQ ID NO: 20015 - protein, 22 aa, Brucella spp.
GGPTVRWVWSALETAWRINQPD

SEQ ID NO: 20016 - protein, 20 aa, Brucella spp.
YREQVLAAFDAFIPGSSPVE

SEQ ID NO: 20017 - protein, 20 aa, Brucella spp.
QEEPFSLLLTDIVMPEMDGI

SEQ ID NO: 20018 - protein, 25 aa, Brucella spp.
EIDPDLKIMFITGFAAVALNPDSDA

SEQ ID NO: 20019 - protein, 18 aa, Brucella spp.
YAIAAAVFYTVVILLSAR

SEQ ID NO: 20020 - protein, 17 aa, Brucella spp.
ASAGRRWLAQSPPNNER

SEQ ID NO: 20021 - protein, 22 aa, Brucella spp.
LDLDLTPGLPMALADRVQIQQV

SEQ ID NO: 20022 - protein, 22 aa, Brucella spp.
TKKGGFGLGLTISRTIVESSGG

SEQ ID NO: 20023 - protein, 25 aa, Brucella spp.
TAACLAGAFLLGGLIGFERQFRHRL

SEQ ID NO: 20024 - protein, 17 aa, Brucella spp.
LGGLIGFERQFRHRLAG

SEQ ID NO: 20025 - protein, 20 aa, Brucella spp.
GIIFKEGFNVRGLNTAATLW

SEQ ID NO: 20026 - protein, 19 aa, Brucella spp.
NALLRPLVQVLEFQAMRRG

SEQ ID NO: 20027 - protein, 20 aa, Brucella spp.
RPLVQVLEFQAMRRGAFQPT

SEQ ID NO: 20028 - protein, 24 aa, Brucella spp.
RERRIPALVQFALAFKNPFIMVLV

SEQ ID NO: 20029 - protein, 23 aa, Brucella spp.
FALAFKNPFIMVLVVLGAISAFT

SEQ ID NO: 20030 - protein, 32 aa, Brucella spp.
INSVSWLLIRFMLIMVPVVFLINGFTKGNWVE

SEQ ID NO: 20031 - protein, 23 aa, Brucella spp.
GNWVEAMLFGLAVAVGLTPEMLP

SEQ ID NO: 20032 - protein, 23 aa, Brucella spp.
RKVDELPFDFIRRRLSVVVEGVG

SEQ ID NO: 20033 - protein, 20 aa, Brucella spp.
GNVFSVLVASAFIPFLPMLA

SEQ ID NO: 20034 - protein, 23 aa, Brucella spp.
VASAFIPFLPMLAIHLLIQNLMY

SEQ ID NO: 20035 - protein, 19 aa, Brucella spp.
DARNIGRFMIWIGPTSSIF

SEQ ID NO: 20036 - protein, 19 aa, Brucella spp.
DITTFALMWYVFSANSPQM

SEQ ID NO: 20037 - protein, 17 aa, Brucella spp.
LLSQTLVVHMLRTQKIP

SEQ ID NO: 20038 - protein, 17 aa, Brucella spp.
VMLMSALIIALGIYIPF

SEQ ID NO: 20039 - protein, 18 aa, Brucella spp.
ALIIALGIYIPFSPIGEM

SEQ ID NO: 20040 - protein, 33 aa, Brucella spp.
SPIGEMVGLVPLPWAYFPWLAATLVSYCLVAQG

SEQ ID NO: 20041 - protein, 21 aa, Brucella spp.
THWIWAASIFFLLLSGLQIFN

SEQ ID NO: 20042 - protein, 26 aa, Brucella spp.
ATGRVVHFFFAWVLVATLLLWFTSSL

SEQ ID NO: 20043 - protein, 18 aa, Brucella spp.
LSYFLVLFGLFPLIVATG

SEQ ID NO: 20044 - protein, 19 aa, Brucella spp.
HFVAMLLLVAFFIVHIAMV

SEQ ID NO: 20045 - protein, 23 aa, Brucella spp.
HGLVEKPLSFSLNELHNMPARTQ

SEQ ID NO: 20046 - protein, 23 aa, Brucella spp.
DCVEGWSTIAKWTGVPLGHILAL

SEQ ID NO: 20047 - protein, 23 aa, Brucella spp.
KWTGVPLGHILALAKPKAGAHYV

SEQ ID NO: 20048 - protein, 20 aa, Brucella spp.
KAGAHYVVFHCFDEVDTPQG

SEQ ID NO: 20049 - protein, 18 aa, Brucella spp.
MPDVDFVDLSAFPDPRAE

SEQ ID NO: 20050 - protein, 17 aa, Brucella spp.
MSAHALYRIGARQYIWY

SEQ ID NO: 20051 - protein, 17 aa, Brucella spp.
LYRIGARQYIWYIRAHH

SEQ ID NO: 20052 - protein, 22 aa, Brucella spp.
ESGHPFHPFASFIHEEDAYRAS

SEQ ID NO: 20053 - protein, 27 aa, Brucella spp.
AKATDIGWPDLLVLLSGLYLSRMLPMQ

SEQ ID NO: 20054 - protein, 26 aa, Brucella spp.
QGEDEGLTLWLPFMSRWGSVGAHMPG

SEQ ID NO: 20055 - protein, 17 aa, Brucella spp.
FFFSPLINVLPFSTPQF

SEQ ID NO: 20056 - protein, 18 aa, Brucella spp.
AAGLPAFLKASLAPHLIE

SEQ ID NO: 20057 - protein, 25 aa, Brucella spp.
LPNIAEFYIVFFALMKAGIAPVNAL

SEQ ID NO: 20058 - protein, 17 aa, Brucella spp.
KNLSAPLLTLFAGEADH

SEQ ID NO: 20059 - protein, 24 aa, Brucella spp.
APNPEPLNCFSIIERHGVNMVALV

SEQ ID NO: 20060 - protein, 22 aa, Brucella spp.
QVLGCKLQQVFGMAEGLVNYTR

SEQ ID NO: 20061 - protein, 19 aa, Brucella spp.
YKLPDRIRLIETMPLTAVG

SEQ ID NO: 20062 - protein, 19 aa, Brucella spp.
ASWRFAGKRVIVTGAAQGI

SEQ ID NO: 20063 - protein, 19 aa, Brucella spp.
EADAPFRLIRLDITDAAEV

SEQ ID NO: 20064 - protein, 22 aa, Brucella spp.
AEGKPLDILVNVAGVLKLGNSD

SEQ ID NO: 20065 - protein, 25 aa, Brucella spp.
NASGPFHLLSQWVPVFRDQRHGAIV

SEQ ID NO: 20066 - protein, 17 aa, Brucella spp.
CVALELAPYGVRCNVVS

SEQ ID NO: 20067 - protein, 27 aa, Brucella spp.
AQLVRGLPEQFKLGIPLGKIAIPDDIA

SEQ ID NO: 20068 - protein, 23 aa, Brucella spp.
AIPDDIANVILFLASDQAGHVTM

SEQ ID NO: 20069 - protein, 23 aa, Brucella spp.
AVAKLGGAIRFVGAVGHDAFGEL

SEQ ID NO: 20070 - protein, 25 aa, Brucella spp.
AFGELALKQMREFGLDTGSVRVIDD

SEQ ID NO: 20071 - protein, 26 aa, Brucella spp.
LERGPKIVILKLGSRGALLVTADEVK

SEQ ID NO: 20072 - protein, 22 aa, Brucella spp.
ADEVKHFTPFKVKVVDTVAAGD

SEQ ID NO: 20073 - protein, 23 aa, Brucella spp.
GDSFNGGFAVAFSQARPLHDCVR

SEQ ID NO: 20074 - protein, 17 aa, Brucella spp.
NVSRRFGAAKSLSASID

SEQ ID NO: 20075 - protein, 21 aa, Brucella spp.
NSARANLSFIERVLLRSTPGS

SEQ ID NO: 20076 - protein, 20 aa, Brucella spp.
CRLPDLSKMLTIPKAIPEEI

SEQ ID NO: 20077 - protein, 26 aa, Brucella spp.
PKAIPEEILLAIGPAKGIGRDRWLEL

SEQ ID NO: 20078 - protein, 23 aa, Brucella spp.
RQFSMAEAAYFLGVSPSNLKKLH

SEQ ID NO: 20079 - protein, 21 aa, Brucella spp.
GNEKLQVIGVVNFKGGSGKTT

SEQ ID NO: 20080 - protein, 21 aa, Brucella spp.
ELDEFPSLYEAIRYDSERKSI

SEQ ID NO: 20081 - protein, 22 aa, Brucella spp.
RRTNFPGLDIIPAMLELQEYEY

SEQ ID NO: 20082 - protein, 18 aa, Brucella spp.
EGKTFWNRIAKALAEVDD

SEQ ID NO: 20083 - protein, 25 aa, Brucella spp.
LDLMSMSQFLLMLGDILKTVRQAGG

SEQ ID NO: 20084 - protein, 23 aa, Brucella spp.
AGGAVHLDWFRYLITRYEPTDVP

SEQ ID NO: 20085 - protein, 19 aa, Brucella spp.
YETVNALDLLEPGKTFGAR

SEQ ID NO: 20086 - protein, 17 aa, Brucella spp.
LLEPGKTFGARIIGSYG

SEQ ID NO: 20087 - protein, 19 aa, Brucella spp.
PGKTFGARIIGSYGTNGRG

SEQ ID NO: 20088 - protein, 25 aa, Brucella spp.
AYGLKDGFDWLLMLHGTSGHNYKNG

SEQ ID NO: 20089 - protein, 17 aa, Brucella spp.
AARNILGKAGYEFDGNR

SEQ ID NO: 20090 - protein, 19 aa, Brucella spp.
EDLYGGKLQNTFTIDYGKI

SEQ ID NO: 20091 - protein, 25 aa, Brucella spp.
TQGRFEFDNGFSLSTGARYDYSRFA

SEQ ID NO: 20092 - protein, 20 aa, Brucella spp.
SRTWLGYVLGDYGYVHARNN

SEQ ID NO: 20093 - protein, 22 aa, Brucella spp.
RARNYKAGVNFGGADWSAGITL

SEQ ID NO: 20094 - protein, 24 aa, Brucella spp.
FGGADWSAGITLFDTRIAGLPNYD

SEQ ID NO: 20095 - protein, 26 aa, Brucella spp.
YRSRGFTLNARYIWNYTTIGATFTKA

SEQ ID NO: 20096 - protein, 18 aa, Brucella spp.
GSFMPIGDMATLFIDQEI

SEQ ID NO: 20097 - protein, 26 aa, Brucella spp.
IPDYNMKVGATLAWAGRISDEAATAA

SEQ ID NO: 20098 - protein, 19 aa, Brucella spp.
IDAVWAPGRTFTFQTAFKF

SEQ ID NO: 20099 - protein, 23 aa, Brucella spp.
VDVLERAVTLLLNGQLVGDIFAS

SEQ ID NO: 20100 - protein, 25 aa, Brucella spp.
VALAIPVGFLMGWYRIARSLIEPWV

SEQ ID NO: 20101 - protein, 23 aa, Brucella spp.
IDESPKIFVIFLASFLSSVVATY

SEQ ID NO: 20102 - protein, 22 aa, Brucella spp.
NVVMRYGGFLALDRLNLDIADG

SEQ ID NO: 20103 - protein, 25 aa, Brucella spp.
VIFQQYALFPWLTVRQNVEFGLTDF

SEQ ID NO: 20104 - protein, 18 aa, Brucella spp.
RLDQIIPVDLPYPRTEAI

SEQ ID NO: 20105 - protein, 17 aa, Brucella spp.
RTEAIRLSPEFAAIRNR

SEQ ID NO: 20106 - protein, 23 aa, Brucella spp.
RLSPEFAAIRNRVWHAVYHQQPQ

SEQ ID NO: 20107 - protein, 18 aa, Brucella spp.
MSLALTFLPSVALADNIP

SEQ ID NO: 20108 - protein, 22 aa, Brucella spp.
DNIPVRVGYIADYWGTSITAIA

SEQ ID NO: 20109 - protein, 20 aa, Brucella spp.
GSLDFGYIGPGALWLPASGK

SEQ ID NO: 20110 - protein, 22 aa, Brucella spp.
GTSGDMLLRLALGKAGMKLDDV

SEQ ID NO: 20111 - protein, 18 aa, Brucella spp.
AAGIWYPLIGTIKEHVPG

SEQ ID NO: 20112 - protein, 19 aa, Brucella spp.
LSGMADMFVTFGKLKSPLD

SEQ ID NO: 20113 - protein, 23 aa, Brucella spp.
GTFYEEGWMKALRDLDYYTTTIS

SEQ ID NO: 20114 - protein, 23 aa, Brucella spp.
ADEIVPMAIDWIARNKSRKWFLH

SEQ ID NO: 20115 - protein, 23 aa, Brucella spp.
GDPFAGEPLPAWMTEEVLARSIA

SEQ ID NO: 20116 - protein, 18 aa, Brucella spp.
WMTEEVLARSIAGYGPHS

SEQ ID NO: 20117 - protein, 26 aa, Brucella spp.
ADEFTCNVPLIIRWPGQAPGVNHGLH

SEQ ID NO: 20118 - protein, 25 aa, Brucella spp.
HGLHYHFDWPATLIDGLGGKVPSVW

SEQ ID NO: 20119 - protein, 20 aa, Brucella spp.
EDWLMLRTWHDGLKDFGPVT

SEQ ID NO: 20120 - protein, 25 aa, Brucella spp.
HDGLKDFGPVTLFNLTSDPHEQTDL

SEQ ID NO: 20121 - protein, 19 aa, Brucella spp.
GGPYHTLGELPAYLERLRA

SEQ ID NO: 20122 - protein, 28 aa, Brucella spp.
AIFIVLPVLRVALMLFQFAQARDIAYVT

SEQ ID NO: 20123 - protein, 19 aa, Brucella spp.
VDTARPWAQAVAISGGRIL

SEQ ID NO: 20124 - protein, 18 aa, Brucella spp.
WAQAVAISGGRILAVGST

SEQ ID NO: 20125 - protein, 24 aa, Brucella spp.
RRQAEAAVPGQWIIANQWGADMIT

SEQ ID NO: 20126 - protein, 20 aa, Brucella spp.
AAIARAVEIVNSYGVTAFQD

SEQ ID NO: 20127 - protein, 18 aa, Brucella spp.
VEIVNSYGVTAFQDAASV

SEQ ID NO: 20128 - protein, 17 aa, Brucella spp.
ASVLPIMKALTGLDNKG

SEQ ID NO: 20129 - protein, 26 aa, Brucella spp.
TSLPLIEPSFMFGLSGDELLALRDEY

SEQ ID NO: 20130 - protein, 17 aa, Brucella spp.
LSPMIWYPTTFLEGHKE

SEQ ID NO: 20131 - protein, 20 aa, Brucella spp.
SDWPVIPVPDPWTGIEGMVT

SEQ ID NO: 20132 - protein, 25 aa, Brucella spp.
WPEQAIDLATAIRIFTLNSAIAMGI

SEQ ID NO: 20133 - protein, 18 aa, Brucella spp.
IFTLNSAIAMGIGAETGS

SEQ ID NO: 20134 - protein, 21 aa, Brucella spp.
LGLDLPWWAWTYIGIAAVAVL

SEQ ID NO: 20135 - protein, 18 aa, Brucella spp.
LVVLEYLVVLVIDAAILF

SEQ ID NO: 20136 - protein, 18 aa, Brucella spp.
YLVVLVIDAAILFSGGDS

SEQ ID NO: 20137 - protein, 25 aa, Brucella spp.
AIGVLFCFAAFIGFEATTVYSEEAR

SEQ ID NO: 20138 - protein, 19 aa, Brucella spp.
RATYISVLIIGIFYMLTAW

SEQ ID NO: 20139 - protein, 19 aa, Brucella spp.
REGLLPRGLGVTHPQYQSP

SEQ ID NO: 20140 - protein, 18 aa, Brucella spp.
TFTAFAIIAFFARRPGLE

SEQ ID NO: 20141 - protein, 37 aa, Brucella spp.
AILSNELDLFYGVEFRKRFPLIELFDVIVDATYTKIL

SEQ ID NO: 20142 - protein, 20 aa, Brucella spp.
GLFELGAVRVRAFRAEAYAV

SEQ ID NO: 20143 - protein, 18 aa, Brucella spp.
AVRVRAFRAEAYAVADLL

SEQ ID NO: 20144 - protein, 23 aa, Brucella spp.
LPQNGFIDMSFRIGVGRSDEEKR

SEQ ID NO: 20145 - protein, 18 aa, Brucella spp.
IDPQLSWKKNAIHPRLRQ

SEQ ID NO: 20146 - protein, 18 aa, Brucella spp.
GQSLKFMAKAALRGAENF

SEQ ID NO: 20147 - protein, 18 aa, Brucella spp.
MAKAALRGAENFRFFADR

SEQ ID NO: 20148 - protein, 21 aa, Brucella spp.
LRGAENFRFFADRAPEARDGK

SEQ ID NO: 20149 - protein, 25 aa, Brucella spp.
TPWNTPFMLSTWKIAPALAAGCTVV

SEQ ID NO: 20150 - protein, 20 aa, Brucella spp.
EAGLPKGVWNLVNGFGEDAG

SEQ ID NO: 20151 - protein, 17 aa, Brucella spp.
DIKAIGFVGESRTGSLI

SEQ ID NO: 20152 - protein, 18 aa, Brucella spp.
EIFGPVLTAIPFKDEAEA

SEQ ID NO: 20153 - protein, 19 aa, Brucella spp.
YLWTNDVTRAFRFTDALEA

SEQ ID NO: 20154 - protein, 19 aa, Brucella spp.
NDVTRAFRFTDALEAGMIW

SEQ ID NO: 20155 - protein, 23 aa, Brucella spp.
FRFTDALEAGMIWVNSENVRHLP

SEQ ID NO: 20156 - protein, 21 aa, Brucella spp.
EHFFKGKGLPVEWVERPYQSR

SEQ ID NO: 20157 - protein, 23 aa, Brucella spp.
TRDPHGIPLEFYSRMDRLPPIHQ

SEQ ID NO: 20158 - protein, 24 aa, Brucella spp.
TEDAETGRLWAAWTHRKGGVHDIT

SEQ ID NO: 20159 - protein, 22 aa, Brucella spp.
GRHGISNAFFLYVRDPDGHRIE

SEQ ID NO: 20160 - protein, 21 aa, Brucella spp.
YEGEIAIVIGKGGRRIAEKDA

SEQ ID NO: 20161 - protein, 25 aa, Brucella spp.
QQDRTSRMIFSFRKIINYVSTFTTL

SEQ ID NO: 20162 - protein, 23 aa, Brucella spp.
GAGARFDPPIWLKPGDVVEVEAE

SEQ ID NO: 20163 - protein, 25 aa, Brucella spp.
YTVEICAGAGYDWLLLDGEHAPNDV

SEQ ID NO: 20164 - protein, 28 aa, Brucella spp.
PPVGETWIVKQLLDIGAQTLLIPMIESR

SEQ ID NO: 20165 - protein, 20 aa, Brucella spp.
YPPHGVRGVGSALARASAFN

SEQ ID NO: 20166 - protein, 21 aa, Brucella spp.
LARHYLDLGATFVAIGNDVTL

SEQ ID NO: 20167 - protein, 22 aa, Brucella spp.
ASPEHPVIGFSIDDLRVERWAR

SEQ ID NO: 20168 - protein, 21 aa, Brucella spp.
RVERWARDRDYFIAAAEKLGA

SEQ ID NO: 20169 - protein, 24 aa, Brucella spp.
LILNADIDAYISFDNERVGFMQAQ

SEQ ID NO: 20170 - protein, 17 aa, Brucella spp.
KIVGSQWVKEWSPTEAL

SEQ ID NO: 20171 - protein, 27 aa, Brucella spp.
GSQWVKEWSPTEALSIMENALTATQNK

SEQ ID NO: 20172 - protein, 19 aa, Brucella spp.
LIAEEAAKLTVQMVRDEKP

SEQ ID NO: 20173 - protein, 17 aa, Brucella spp.
DNIDIYIKDGFYTKEQI

SEQ ID NO: 20174 - protein, 22 aa, Brucella spp.
QMAEILMPLLAAKMEHEAVAEF

SEQ ID NO: 20175 - protein, 20 aa, Brucella spp.
AVAEFARRIAALALEGEAPE

SEQ ID NO: 20176 - protein, 20 aa, Brucella spp.
SNELSFSFGERMLETRIAPL

SEQ ID NO: 20177 - protein, 20 aa, Brucella spp.
LLVLMASLSFAGVAGGTACA

SEQ ID NO: 20178 - protein, 24 aa, Brucella spp.
QPEMRPLPVLEPYKLVRSLRMLQD

SEQ ID NO: 20179 - protein, 19 aa, Brucella spp.
EAVVMLNKLLGFVSTDMSR

SEQ ID NO: 20180 - protein, 22 aa, Brucella spp.
DKPENIYAAIIYLFNGGNPEAV

SEQ ID NO: 20181 - protein, 23 aa, Brucella spp.
GQTIEVVKLFSVPLAPEVPAELK

SEQ ID NO: 20182 - protein, 25 aa, Brucella spp.
PEVPAELKASIVLVTANQMMAFDPA

SEQ ID NO: 20183 - protein, 18 aa, Brucella spp.
AIRRSLPIAAKRGAADKV

SEQ ID NO: 20184 - protein, 20 aa, Brucella spp.
DPLLQYTLYLQIARGALVDG

SEQ ID NO: 20185 - protein, 22 aa, Brucella spp.
GGSDPATLFGALLEKPHGKVDA

SEQ ID NO: 20186 - protein, 27 aa, Brucella spp.
DGSGQKPVAVFGLPQNLLSLASALPGQ

SEQ ID NO: 20187 - protein, 20 aa, Brucella spp.
AAVSEPGMVDVVDPAGIDKA

SEQ ID NO: 20188 - protein, 24 aa, Brucella spp.
DDEKRPLRELPRVKAAQTNGDLAI

SEQ ID NO: 20189 - protein, 20 aa, Brucella spp.
EPAKGMDVRADLLPQQAAAK

SEQ ID NO: 20190 - protein, 19 aa, Brucella spp.
AKAAAGMPEAARIADIEVV

SEQ ID NO: 20191 - protein, 21 aa, Brucella spp.
AGMPEAARIADIEVVSERSFG

SEQ ID NO: 20192 - protein, 34 aa, Brucella spp.
RIADIEVVSERSFGTVKTLQIRLDPVELGAVTAR

SEQ ID NO: 20193 - protein, 25 aa, Brucella spp.
RLDPVELGAVTARIRVAGDSVEVHL

SEQ ID NO: 20194 - protein, 17 aa, Brucella spp.
QQQGHQLAFNMQQQGSQ

SEQ ID NO: 20195 - protein, 19 aa, Brucella spp.
QGHQLAFNMQQQGSQGRGG

SEQ ID NO: 20196 - protein, 20 aa, Brucella spp.
RGGEAQAQFMSGRSGGEGGR

SEQ ID NO: 20197 - protein, 19 aa, Brucella spp.
QLSGEIGITTMMRGDNDMV

SEQ ID NO: 20198 - protein, 23 aa, Brucella spp.
PFGTGRLSGLLQLRDQIAPQYQM

SEQ ID NO: 20199 - protein, 21 aa, Brucella spp.
QLDEIARGLVTVFAESDQTGS

SEQ ID NO: 20200 - protein, 26 aa, Brucella spp.
GSSPDQTGLFSWSGSPAIPGAGLSAG

SEQ ID NO: 20201 - protein, 17 aa, Brucella spp.
WSGSPAIPGAGLSAGIA

SEQ ID NO: 20202 - protein, 21 aa, Brucella spp.
GTIEVSVPFIASEGGSALLLR

SEQ ID NO: 20203 - protein, 24 aa, Brucella spp.
PFIASEGGSALLLRDGGANGANYK

SEQ ID NO: 20204 - protein, 24 aa, Brucella spp.
ANYKYNVQGAAGFSDRLRALNEAF

SEQ ID NO: 20205 - protein, 25 aa, Brucella spp.
RALNEAFSEPMVFDAAAGISSSSSL

SEQ ID NO: 20206 - protein, 25 aa, Brucella spp.
VDIDTEMALLLDLEHSYQASSRVLT

SEQ ID NO: 20207 - protein, 20 aa, Brucella spp.
TTGTVFDVGLSLGSRTGQTV

SEQ ID NO: 20208 - protein, 23 aa, Brucella spp.
VSLRKEYDRLSVLTDMNKLVQQR

SEQ ID NO: 20209 - protein, 23 aa, Brucella spp.
LNTSFNGEYIFAGVNTDVKPISD

SEQ ID NO: 20210 - protein, 23 aa, Brucella spp.
VRQAFQDHFGFAMDDPQVANISG

SEQ ID NO: 20211 - protein, 20 aa, Brucella spp.
MKAFLEGDFAEQFNDANWAA

SEQ ID NO: 20212 - protein, 21 aa, Brucella spp.
RKTVMSAVMVTEFADIGLNAS

SEQ ID NO: 20213 - protein, 19 aa, Brucella spp.
TQIETSYSLTVQLQNMSLL

SEQ ID NO: 20214 - protein, 28 aa, Brucella spp.
ENALPKELRAAIISIGIFVLKEIERIRQ

SEQ ID NO: 20215 - protein, 25 aa, Brucella spp.
NKASVDYDSFLKLLVTQMQNQDPTQ

SEQ ID NO: 20216 - protein, 24 aa, Brucella spp.
TSLTQAEGWIGRTLTNADGSISGV

SEQ ID NO: 20217 - protein, 21 aa, Brucella spp.
NEIILAAVLAFCRIGACLMLM

SEQ ID NO: 20218 - protein, 19 aa, Brucella spp.
ARIPLQVRLFIALACSFAV

SEQ ID NO: 20219 - protein, 17 aa, Brucella spp.
AGQPWTLFRLMVGEMFI

SEQ ID NO: 20220 - protein, 17 aa, Brucella spp.
QPWTLFRLMVGEMFIGA

SEQ ID NO: 20221 - protein, 18 aa, Brucella spp.
PFVLGGGLLVVYFILPEL

SEQ ID NO: 20222 - protein, 23 aa, Brucella spp.
LWICAVALGSLFLAVNRDVSASA

SEQ ID NO: 20223 - protein, 24 aa, Brucella spp.
IHKKLTVPLEYFISDEIFHKFYGS

SEQ ID NO: 20224 - protein, 18 aa, Brucella spp.
YFISDEIFHKFYGSYSDT

SEQ ID NO: 20225 - protein, 25 aa, Brucella spp.
NARFPEPVIKDLLVEQFNYISSEEI

SEQ ID NO: 20226 - protein, 22 aa, Brucella spp.
GPLGCFIIWRRMAYFGDTMAHS

SEQ ID NO: 20227 - protein, 18 aa, Brucella spp.
FMTWVRVDLLSFLFGDIL

SEQ ID NO: 20228 - protein, 18 aa, Brucella spp.
VDLLSFLFGDILAVSRID

SEQ ID NO: 20229 - protein, 20 aa, Brucella spp.
LAVLAWLWRPLLAATVSEDI

SEQ ID NO: 20230 - protein, 21 aa, Brucella spp.
MNPALSRIIFMLLLAIVIAIA

SEQ ID NO: 20231 - protein, 17 aa, Brucella spp.
AIAMKIVGILLITSLLI

SEQ ID NO: 20232 - protein, 26 aa, Brucella spp.
DRTLPLSVERLMTLTGPLPRKEIDAA

SEQ ID NO: 20233 - protein, 21 aa, Brucella spp.
SGEAALYELIARLRDDTSCGV

SEQ ID NO: 20234 - protein, 21 aa, Brucella spp.
LLISHDLHLVMAATDRVICLN

SEQ ID NO: 20235 - protein, 20 aa, Brucella spp.
SSPEYVRLFGSRAVGPLAVY

SEQ ID NO: 20236 - protein, 17 aa, Brucella spp.
LASAFLAGFCGSSLAGE

SEQ ID NO: 20237 - protein, 25 aa, Brucella spp.
AEAIEHAKVIFWAGPSMETFLDKPI

SEQ ID NO: 20238 - protein, 19 aa, Brucella spp.
KGLTKLKFREGGPFEAHDH

SEQ ID NO: 20239 - protein, 23 aa, Brucella spp.
HHHGEYDLHFWLDPQNGKILAAD

SEQ ID NO: 20240 - protein, 25 aa, Brucella spp.
AELKPVKDKPFIVFHDAYQYFENRF

SEQ ID NO: 20241 - protein, 22 aa, Brucella spp.
DKIKSLGATCVFSEPQFEPKLV

SEQ ID NO: 20242 - protein, 19 aa, Brucella spp.
LKDGPDLYPQLIRNLANSL

SEQ ID NO: 20243 - protein, 19 aa, Brucella spp.
RLSSIGLLSVVRYRAVHAK

SEQ ID NO: 20244 - protein, 18 aa, Brucella spp.
RNTLDWFERLPAEIEKKI

SEQ ID NO: 20245 - protein, 18 aa, Brucella spp.
PLHGLPWAIKDLLPTKDI

SEQ ID NO: 20246 - protein, 23 aa, Brucella spp.
LRGKRIAWLGNWGGAYPCEAGIL

SEQ ID NO: 20247 - protein, 19 aa, Brucella spp.
VPLEPPFSSQALWEAWITL

SEQ ID NO: 20248 - protein, 33 aa, Brucella spp.
EYDALIMPTAQVWPFPADWRWPQHINGQPMDSY

SEQ ID NO: 20249 - protein, 24 aa, Brucella spp.
HRWMEVVVPVSLIGLAALSVPVGF

SEQ ID NO: 20250 - protein, 18 aa, Brucella spp.
TAAAHFVSGHPLKGPWPD

SEQ ID NO: 20251 - protein, 36 aa, Brucella spp.
KGPWPDGMKQVLFGMGCFWGAERLFWQVPGVYVTAV

SEQ ID NO: 20252 - protein, 18 aa, Brucella spp.
VVTLNELLALFWEEHDPT

SEQ ID NO: 20253 - protein, 27 aa, Brucella spp.
RRLLKEISLLLCYEVTRNLELTTMSIE

SEQ ID NO: 20254 - protein, 21 aa, Brucella spp.
VLEGKKLVFASILRAGNGLLE

SEQ ID NO: 20255 - protein, 17 aa, Brucella spp.
IVNRLVIVVDPMLATAN

SEQ ID NO: 20256 - protein, 24 aa, Brucella spp.
RGATNIRFLCLLAAPEGIERFTKA

SEQ ID NO: 20257 - protein, 17 aa, Brucella spp.
EGLSGLPALGHRIAGFL

SEQ ID NO: 20258 - protein, 18 aa, Brucella spp.
MSDIPALEAAGFDLKKLA

SEQ ID NO: 20259 - protein, 20 aa, Brucella spp.
KKLAETLIQSFLRHTLRDGF

SEQ ID NO: 20260 - protein, 19 aa, Brucella spp.
LVVAVDFGITGRLDKQQRR

SEQ ID NO: 20261 - protein, 25 aa, Brucella spp.
QRRFLAEILYGFITRDYMRVAEVHF

SEQ ID NO: 20262 - protein, 18 aa, Brucella spp.
TISMAKLLTLLFEVTELF

SEQ ID NO: 20263 - protein, 23 aa, Brucella spp.
MWKAAEPVVGDWIRKNLGPQGMV

SEQ ID NO: 20264 - protein, 17 aa, Brucella spp.
ILLIIGGGIAAYKTPDL

SEQ ID NO: 20265 - protein, 18 aa, Brucella spp.
VSADHVFTDLFSREDEQD

SEQ ID NO: 20266 - protein, 33 aa, Brucella spp.
ADDLASAVLLARKVPLLIAPAMNPAMWDNPATR

SEQ ID NO: 20267 - protein, 20 aa, Brucella spp.
GRMSEPLAIVAAIENLLSPQ

SEQ ID NO: 20268 - protein, 17 aa, Brucella spp.
AAALARLGATVHLVSGP

SEQ ID NO: 20269 - protein, 19 aa, Brucella spp.
ADAAVMVAAVADWRSANEA

SEQ ID NO: 20270 - protein, 19 aa, Brucella spp.
KKPGEGAPVLAMVENPDIL

SEQ ID NO: 20271 - protein, 18 aa, Brucella spp.
HSKKRPGLVVGFAAETQD

SEQ ID NO: 20272 - protein, 21 aa, Brucella spp.
WPHILFVLSIVLGAIAAIHAT

SEQ ID NO: 20273 - protein, 24 aa, Brucella spp.
MTKEEVRTAIGWVGVIVLSPIVGA

SEQ ID NO: 20274 - protein, 17 aa, Brucella spp.
ARYSFPSIVKLLKEKGV

SEQ ID NO: 20275 - protein, 18 aa, Brucella spp.
NIIIGLRLPYANLRTHRK

SEQ ID NO: 20276 - protein, 20 aa, Brucella spp.
FKLEGPAIADLFHIASEDWR

SEQ ID NO: 20277 - protein, 17 aa, Brucella spp.
RELISALVTAARRGVSV

SEQ ID NO: 20278 - protein, 22 aa, Brucella spp.
RFGERSGLLDLGLLERRHGLVP

SEQ ID NO: 20279 - protein, 17 aa, Brucella spp.
GLVPVPITATMPKGHGW

SEQ ID NO: 20280 - protein, 17 aa, Brucella spp.
KGHGWHGNVLLLRESVV

SEQ ID NO: 20281 - protein, 20 aa, Brucella spp.
EPRGALVADLQFPAGPLRVI

SEQ ID NO: 20282 - protein, 19 aa, Brucella spp.
VADLQFPAGPLRVIAAHLG

SEQ ID NO: 20283 - protein, 18 aa, Brucella spp.
TLPTLLIGDLNEWRIGKR

SEQ ID NO: 20284 - protein, 26 aa, Brucella spp.
TAVPSFPSRFPVLALDRVLGAPDNLI

SEQ ID NO: 20285 - protein, 17 aa, Brucella spp.
KAHLDLKTAMQLLESHN

SEQ ID NO: 20286 - protein, 19 aa, Brucella spp.
ETFFELIKWRRDVRHFRRD

SEQ ID NO: 20287 - protein, 19 aa, Brucella spp.
EGIETAPVQLAVFTDTAPA

SEQ ID NO: 20288 - protein, 33 aa, Brucella spp.
AMEQLFEVPPSWRFTLYLCIGWPCTEDDTPLLH

SEQ ID NO: 20289 - protein, 24 aa, Brucella spp.
GQSEWNLKNLFTGWRDPGLTEQGH

SEQ ID NO: 20290 - protein, 23 aa, Brucella spp.
KAAGLKFDIAYTSALSRAQVTCQ

SEQ ID NO: 20291 - protein, 20 aa, Brucella spp.
LKDTGARVWPYYLHTIQPHV

SEQ ID NO: 20292 - protein, 25 aa, Brucella spp.
LKQELNTGVPIIYRLNADSTVASKE

SEQ ID NO: 20293 - protein, 19 aa, Brucella spp.
MSLGVNLLSVLVQKAAEAL

SEQ ID NO: 20294 - protein, 18 aa, Brucella spp.
ETGTIGFATLRGGSVIGD

SEQ ID NO: 20295 - protein, 25 aa, Brucella spp.
RSIFARGAIKAALWAHGKKPGLYSM

SEQ ID NO: 20296 - protein, 23 aa, Brucella spp.
IREYKQNYLIAIIASLIVGGSNG

SEQ ID NO: 20297 - protein, 37 aa, Brucella spp.
DKIFYEQNLALVWVICGALLTIFVLRGISGYVQAVEL

SEQ ID NO: 20298 - protein, 24 aa, Brucella spp.
RIFDHLMKLGLDFYNDTRSGHLAA

SEQ ID NO: 20299 - protein, 25 aa, Brucella spp.
SIARDFISLVGLVGMMFYMDPVLSV

SEQ ID NO: 20300 - protein, 25 aa, Brucella spp.
MFYMDPVLSVAIFLIGPPLILAVAY

SEQ ID NO: 20301 - protein, 18 aa, Brucella spp.
PPLILAVAYISRRIRSVT

SEQ ID NO: 20302 - protein, 21 aa, Brucella spp.
QESIQGIAIVKAFTMEDQLRA

SEQ ID NO: 20303 - protein, 19 aa, Brucella spp.
ILAGVAVSGVLVYSGYRAI

SEQ ID NO: 20304 - protein, 18 aa, Brucella spp.
VSGVLVYSGYRAILEHQP

SEQ ID NO: 20305 - protein, 17 aa, Brucella spp.
EHQPPGATFAFITAMLL

SEQ ID NO: 20306 - protein, 21 aa, Brucella spp.
QPPGATFAFITAMLLAYDPAR

SEQ ID NO: 20307 - protein, 18 aa, Brucella spp.
PYLFEGTIADNIRYGRPD

SEQ ID NO: 20308 - protein, 20 aa, Brucella spp.
QSFKFPVLVGDIGGTNARFS

SEQ ID NO: 20309 - protein, 19 aa, Brucella spp.
VVRPKKMIADLGFEDVTVL

SEQ ID NO: 20310 - protein, 17 aa, Brucella spp.
KKMIADLGFEDVTVLND

SEQ ID NO: 20311 - protein, 19 aa, Brucella spp.
GLVCTRHAWVPVPGEGGHI

SEQ ID NO: 20312 - protein, 18 aa, Brucella spp.
ETLDLFATYLGRLAGDLA

SEQ ID NO: 20313 - protein, 25 aa, Brucella spp.
TYLGRLAGDLALIFMAHGGVYLSGG

SEQ ID NO: 20314 - protein, 25 aa, Brucella spp.
LSGGIPVRILSALKAGSFRAAFEDK

SEQ ID NO: 20315 - protein, 25 aa, Brucella spp.
MIAEGTVEVLIFFIDPLSPLPHDVD

SEQ ID NO: 20316 - protein, 19 aa, Brucella spp.
GSVYDIPMALNRATAEKLV

SEQ ID NO: 20317 - protein, 17 aa, Brucella spp.
RRFVLGVLVAFLPAAVI

SEQ ID NO: 20318 - protein, 24 aa, Brucella spp.
MDYPLPICLAIGFIQCLAMIPGVS

SEQ ID NO: 20319 - protein, 19 aa, Brucella spp.
SAAEFSFFLAMPTMAGAFA

SEQ ID NO: 20320 - protein, 24 aa, Brucella spp.
YVSRHGFALFGWWRLIVGSAGMAA

SEQ ID NO: 20321 - protein, 21 aa, Brucella spp.
NRPKLVTVFGGSGFVGRAVVA

SEQ ID NO: 20322 - protein, 23 aa, Brucella spp.
VRKPEIAYYMAPLGNVGQIQMVQ

SEQ ID NO: 20323 - protein, 18 aa, Brucella spp.
GKLMPGGIYELGGPDVQP

SEQ ID NO: 20324 - protein, 23 aa, Brucella spp.
GGPDVQPFKAWMQDMLKVIGRKR

SEQ ID NO: 20325 - protein, 27 aa, Brucella spp.
VIGRKRMIVSMPWWAARLQASILNLLP

SEQ ID NO: 20326 - protein, 26 aa, Brucella spp.
PETVDAILPAYLWRYRVAGQYTKTGF

SEQ ID NO: 20327 - protein, 21 aa, Brucella spp.
GHVDFAYEVSRSLAACEGSLL

SEQ ID NO: 20328 - protein, 23 aa, Brucella spp.
GAKYPVERTGVFTPKMVQVDDLG

SEQ ID NO: 20329 - protein, 21 aa, Brucella spp.
FKPAQPVVFCGLFPVDAADFE

SEQ ID NO: 20330 - protein, 19 aa, Brucella spp.
KLRLNDASFSFEMETSAAL

SEQ ID NO: 20331 - protein, 39 aa, Brucella spp.
NDASFSFEMETSAALGFGFRCGFLGLLHLEIIQERLERE

SEQ ID NO: 20332 - protein, 22 aa, Brucella spp.
ERRGIQIDLTYVGPRAMITYDL

SEQ ID NO: 20333 - protein, 20 aa, Brucella spp.
PLNEVVFDFYDRLKSISKGY

SEQ ID NO: 20334 - protein, 20 aa, Brucella spp.
EPVDALSMLVHRSAAEKRGR

SEQ ID NO: 20335 - protein, 26 aa, Brucella spp.
EKLKELIPQHMFKIPIQAAIGGRIVA

SEQ ID NO: 20336 - protein, 19 aa, Brucella spp.
FKIPIQAAIGGRIVARETI

SEQ ID NO: 20337 - protein, 22 aa, Brucella spp.
PEFSVPILTAIIGHGYEVVAAY

SEQ ID NO: 20338 - protein, 18 aa, Brucella spp.
QFGIPVFTPKSLKGAEEQ

SEQ ID NO: 20339 - protein, 21 aa, Brucella spp.
EADVAIVVAYGLLLPKAILDA

SEQ ID NO: 20340 - protein, 18 aa, Brucella spp.
CYNGHASLLPRWRGAAPI

SEQ ID NO: 20341 - protein, 22 aa, Brucella spp.
GHASLLPRWRGAAPIQRAIMAG

SEQ ID NO: 20342 - protein, 26 aa, Brucella spp.
FFPGRFDVATLFAFVMFGISIVLSYR

SEQ ID NO: 20343 - protein, 19 aa, Brucella spp.
SIVLSYRLTFVALQRPHTY

SEQ ID NO: 20344 - protein, 21 aa, Brucella spp.
EKMLKLMGFSANRPVFSDDNT

SEQ ID NO: 20345 - protein, 17 aa, Brucella spp.
PPFAAAIEDGVMYGRGA

SEQ ID NO: 20346 - protein, 18 aa, Brucella spp.
GGIACFVAAVARHIEKHG

SEQ ID NO: 20347 - protein, 23 aa, Brucella spp.
KHGNIKGSISFLITGDEEGPAVN

SEQ ID NO: 20348 - protein, 17 aa, Brucella spp.
AAYPHLAENPVRGIVTL

SEQ ID NO: 20349 - protein, 25 aa, Brucella spp.
QGRETPIKYELTWRERPSHVFLTHD

SEQ ID NO: 20350 - protein, 20 aa, Brucella spp.
FIKDYCPVVEFGLTGQTMHM

SEQ ID NO: 20351 - protein, 28 aa, Brucella spp.
HVNQWLKKAVLLSFRLNPMEVIKGGPGQ

SEQ ID NO: 20352 - protein, 21 aa, Brucella spp.
NAILMPSFVNLGAYVDKGAMI

SEQ ID NO: 20353 - protein, 18 aa, Brucella spp.
IIEDNCFIGARSEVVEGC

SEQ ID NO: 20354 - protein, 20 aa, Brucella spp.
REGSVLGMGVFIGKSTKIVD

SEQ ID NO: 20355 - protein, 18 aa, Brucella spp.
VPPYSVVVAGTMPGKNVP

SEQ ID NO: 20356 - protein, 22 aa, Brucella spp.
QTEAPAYRLAFMDDEFMTRRDL

SEQ ID NO: 20357 - protein, 18 aa, Brucella spp.
RLQLELLKPEMILADRGI

SEQ ID NO: 20358 - protein, 23 aa, Brucella spp.
TPDLCFNFHYFAIRKMHFLMRAK

SEQ ID NO: 20359 - protein, 22 aa, Brucella spp.
MERMPLILFGKEFWTKAINIEF

SEQ ID NO: 20360 - protein, 17 aa, Brucella spp.
AFAHVTDWVFDLDNTLY

SEQ ID NO: 20361 - protein, 21 aa, Brucella spp.
VPNNFEPAFSEIWESDPEFTD

SEQ ID NO: 20362 - protein, 29 aa, Brucella spp.
AEEGRLLFKKSWIFIRGVPSMKFLPPEGP

SEQ ID NO: 20363 - protein, 23 aa, Brucella spp.
FLPPEGPVEIAFAGRSNVGKSSL

SEQ ID NO: 20364 - protein, 20 aa, Brucella spp.
NGDLPPLALVDMPGYGFAEA

SEQ ID NO: 20365 - protein, 26 aa, Brucella spp.
HKLTYKRAACFPGIIATSSEKGQGLD

SEQ ID NO: 20366 - protein, 24 aa, Brucella spp.
ITIALSILILALWQVFYLGPKTEA

SEQ ID NO: 20367 - protein, 30 aa, Brucella spp.
YHIKQFDLLIDWGWFYFITKPMFYLIDWIY

SEQ ID NO: 20368 - protein, 17 aa, Brucella spp.
ITKPMFYLIDWIYKFTG

SEQ ID NO: 20369 - protein, 25 aa, Brucella spp.
KPMFYLIDWIYKFTGNFGVAILVVT

SEQ ID NO: 20370 - protein, 19 aa, Brucella spp.
YKFTGNFGVAILVVTVLLK

SEQ ID NO: 20371 - protein, 30 aa, Brucella spp.
NPLAGCWPVLVQIPVFFALYKVLYVTIEMR

SEQ ID NO: 20372 - protein, 18 aa, Brucella spp.
YVTIEMRHAPFFGWIQDL

SEQ ID NO: 20373 - protein, 19 aa, Brucella spp.
MRHAPFFGWIQDLAAPDPT

SEQ ID NO: 20374 - protein, 21 aa, Brucella spp.
PDPTSIFNLFGLLPYTVPHFL

SEQ ID NO: 20375 - protein, 33 aa, Brucella spp.
PYTVPHFLMIGVWPIIMGIIMFLQMRMNPTPPD

SEQ ID NO: 20376 - protein, 26 aa, Brucella spp.
LASFPAGLVIYWAWNNTLSIIQQSVI

SEQ ID NO: 20377 - protein, 18 aa, Brucella spp.
GPLFLMAVRERTEEESNA

SEQ ID NO: 20378 - protein, 21 aa, Brucella spp.
RRLKEAIRCHAGRDMAPSTDY

SEQ ID NO: 20379 - protein, 22 aa, Brucella spp.
RDMAPSTDYVIVAREQALNAPF

SEQ ID NO: 20380 - protein, 23 aa, Brucella spp.
DGLPRPRIYWAWATLMVGLTLAV

SEQ ID NO: 20381 - protein, 17 aa, Brucella spp.
FGTAIGLNALFVAVSST

SEQ ID NO: 20382 - protein, 27 aa, Brucella spp.
MLSSLSWPWLFVINIPLGIAAVLMGLR

SEQ ID NO: 20383 - protein, 17 aa, Brucella spp.
ILCAVTFGLLITTIDSA

SEQ ID NO: 20384 - protein, 20 aa, Brucella spp.
PLLPLDLLRIPVFTLSICTS

SEQ ID NO: 20385 - protein, 24 aa, Brucella spp.
ISLPFLFQTVFGFRPIEVGFLMMP

SEQ ID NO: 20386 - protein, 27 aa, Brucella spp.
GFRPIEVGFLMMPWPIALALVAPLSGK

SEQ ID NO: 20387 - protein, 27 aa, Brucella spp.
PTIPDICWRMAICGIGFGLFQAPNNRM

SEQ ID NO: 20388 - protein, 22 aa, Brucella spp.
WGVEGTPYILFLASGFALFASV

SEQ ID NO: 20389 - protein, 23 aa, Brucella spp.
VPDADRIAFPRLGVVVDTETTGL

SEQ ID NO: 20390 - protein, 20 aa, Brucella spp.
EEIIEIGAVAFRYADDGSIG

SEQ ID NO: 20391 - protein, 18 aa, Brucella spp.
PIPAEITRITGITDEMVK

SEQ ID NO: 20392 - protein, 26 aa, Brucella spp.
GFDRPFLERLSIAFANKPWACSVKEI

SEQ ID NO: 20393 - protein, 17 aa, Brucella spp.
GFEGTKLGYLIGQSGYF

SEQ ID NO: 20394 - protein, 20 aa, Brucella spp.
GTKLGYLIGQSGYFHNGHRA

SEQ ID NO: 20395 - protein, 23 aa, Brucella spp.
ELEYLRTEIYGWRDADPLIQKLT

SEQ ID NO: 20396 - protein, 29 aa, Brucella spp.
SRGSRLPFGFKGLGRVAAFVATGLVAGGW

SEQ ID NO: 20397 - protein, 22 aa, Brucella spp.
DKPVETALLVELRADRVRRKEP

SEQ ID NO: 20398 - protein, 22 aa, Brucella spp.
YNRDGLLAHTFMLGRRGDSNGC

SEQ ID NO: 20399 - protein, 25 aa, Brucella spp.
DSNGCVVFKDYARFLRAFKRGEVNR

SEQ ID NO: 20400 - protein, 22 aa, Brucella spp.
HWAFVLRILCAVALVSVGLAHK

SEQ ID NO: 20401 - protein, 18 aa, Brucella spp.
GKEIRPLVAKNCIERGDM

SEQ ID NO: 20402 - protein, 22 aa, Brucella spp.
VELESVNFMGFAHEHHHEKDGV

SEQ ID NO: 20403 - protein, 17 aa, Brucella spp.
LTDEDDFFMSLCFCDHC

SEQ ID NO: 20404 - protein, 22 aa, Brucella spp.
DEDDFFMSLCFCDHCKARAKAA

SEQ ID NO: 20405 - protein, 19 aa, Brucella spp.
DFPQAGISAFAKWPSLYAF

SEQ ID NO: 20406 - protein, 30 aa, Brucella spp.
AGISAFAKWPSLYAFLQWRTEPVTSLIGEI

SEQ ID NO: 20407 - protein, 18 aa, Brucella spp.
LIDLKDGWLGGVDLEEAV

SEQ ID NO: 20408 - protein, 24 aa, Brucella spp.
PADKYVGLGLSLFYSLVKSKEEFA

SEQ ID NO: 20409 - protein, 18 aa, Brucella spp.
AVNVFLPAIVDFDAMNAV

SEQ ID NO: 20410 - protein, 19 aa, Brucella spp.
LPAIVDFDAMNAVYDAWID

SEQ ID NO: 20411 - protein, 20 aa, Brucella spp.
PGQWKLWLLYTAGFVPAVWT

SEQ ID NO: 20412 - protein, 24 aa, Brucella spp.
TFEHLLGLWALRFLILTLLVTPMR

SEQ ID NO: 20413 - protein, 26 aa, Brucella spp.
MRCVEAWSMVIPWIGFPLSSLLSQVE

SEQ ID NO: 20414 - protein, 19 aa, Brucella spp.
WPYVEGLRLDEAMHPLTIL

SEQ ID NO: 20415 - protein, 28 aa, Brucella spp.
ANGAPIRLVVPWKYGFKGIKAITRISFV

SEQ ID NO: 20416 - protein, 17 aa, Brucella spp.
ADLNVNFLPAQPVGYSI

SEQ ID NO: 20417 - protein, 19 aa, Brucella spp.
RLDMLAVATSWTRFGLPEG

SEQ ID NO: 20418 - protein, 19 aa, Brucella spp.
VATSWTRFGLPEGLITPEE

SEQ ID NO: 20419 - protein, 23 aa, Brucella spp.
GGFIETSVMLALRPDLVDMAKAR

SEQ ID NO: 20420 - protein, 25 aa, Brucella spp.
QFAEEFKYLRAYGPHAFGWKMHDLN

SEQ ID NO: 20421 - protein, 19 aa, Brucella spp.
LLAHAVSGFIDLLRDVDRF

SEQ ID NO: 20422 - protein, 17 aa, Brucella spp.
VTRPEEIARAFDEGESR

SEQ ID NO: 20423 - protein, 23 aa, Brucella spp.
EGESRFGPISALFNNAGVAHMAR

SEQ ID NO: 20424 - protein, 23 aa, Brucella spp.
EHIFEVNVAGAFFTAQEVARRMI

SEQ ID NO: 20425 - protein, 18 aa, Brucella spp.
RALALEWAAHDIRVNAIS

SEQ ID NO: 20426 - protein, 19 aa, Brucella spp.
VNAISPGWFPTRINEEQLQ

SEQ ID NO: 20427 - protein, 23 aa, Brucella spp.
LYGNRTTLWFGLLAHVVACVVIY

SEQ ID NO: 20428 - protein, 28 aa, Brucella spp.
TADWHFLGFAGIFTFVAFGRLYDMHKFD

SEQ ID NO: 20429 - protein, 22 aa, Brucella spp.
ATLGMLCFFSSYVLRDAFAELA

SEQ ID NO: 20430 - protein, 17 aa, Brucella spp.
AFAELASLTVLLASVVS

SEQ ID NO: 20431 - protein, 20 aa, Brucella spp.
CTLMPVLAGLILAGTPFHII

SEQ ID NO: 20432 - protein, 26 aa, Brucella spp.
AGTPFHIIIGLLLIPYFLSNIQMANG

SEQ ID NO: 20433 - protein, 23 aa, Brucella spp.
GRKLEVLLRYCVKQGLFPHNDLT

SEQ ID NO: 20434 - protein, 19 aa, Brucella spp.
RFDGLTGLPNRNYFETMMR

SEQ ID NO: 20435 - protein, 20 aa, Brucella spp.
FGGDEFVIFVFNLHDSSEVN

SEQ ID NO: 20436 - protein, 20 aa, Brucella spp.
LRIVACEALARWNHAELGLV

SEQ ID NO: 20437 - protein, 21 aa, Brucella spp.
AELGLVPPAEFIPLAEEIGLI

SEQ ID NO: 20438 - protein, 19 aa, Brucella spp.
LAEEIGLISEITRFMLEQA

SEQ ID NO: 20439 - protein, 17 aa, Brucella spp.
LEQACMDCLSWGDKIVV

SEQ ID NO: 20440 - protein, 23 aa, Brucella spp.
QACMDCLSWGDKIVVSVNLSAID

SEQ ID NO: 20441 - protein, 17 aa, Brucella spp.
LVQGYLFGMPLPTEEIS

SEQ ID NO: 20442 - protein, 23 aa, Brucella spp.
YLVSGVLFILALRGLSHPTTSRQ

SEQ ID NO: 20443 - protein, 18 aa, Brucella spp.
RPSFGGLVLIIVGIAIGG

SEQ ID NO: 20444 - protein, 23 aa, Brucella spp.
ALIEMSLGVAIGAITFTGSIIAF

SEQ ID NO: 20445 - protein, 32 aa, Brucella spp.
LTNTESHFVFWLIVLLSLVFGVLIIVPIGGAD

SEQ ID NO: 20446 - protein, 19 aa, Brucella spp.
VEVKYAIHPVAGRMPGHMN

SEQ ID NO: 20447 - protein, 27 aa, Brucella spp.
TGYRLPEEAGAAFWPATRTLFAQALQP

SEQ ID NO: 20448 - protein, 21 aa, Brucella spp.
GKPAPDLFLFAADKMGVDPAR

SEQ ID NO: 20449 - protein, 26 aa, Brucella spp.
MRDFDQAIALNPNFYQAYANRALVDR

SEQ ID NO: 20450 - protein, 23 aa, Brucella spp.
DYSRAIQLNPQYDAAYIGRGNVY

SEQ ID NO: 20451 - protein, 18 aa, Brucella spp.
QALNDFNQAIALRTTDGR

SEQ ID NO: 20452 - protein, 20 aa, Brucella spp.
YNGRGISYVALGDYDNAFDD

SEQ ID NO: 20453 - protein, 18 aa, Brucella spp.
QNVAESWANQALVYEHNG

SEQ ID NO: 20454 - protein, 18 aa, Brucella spp.
VQLDPKYKPAKDGLARTR

SEQ ID NO: 20455 - protein, 20 aa, Brucella spp.
WRSFWETIIMAGFSSLISLV

SEQ ID NO: 20456 - protein, 20 aa, Brucella spp.
RSVPFIILLVALIPVTRFIV

SEQ ID NO: 20457 - protein, 21 aa, Brucella spp.
REVLIPEALPGIIAGFTVTVI

SEQ ID NO: 20458 - protein, 17 aa, Brucella spp.
QVMIAVVIILIIMVCGI

SEQ ID NO: 20459 - protein, 19 aa, Brucella spp.
GDPDKVSFIPLSTKERFTA

SEQ ID NO: 20460 - protein, 23 aa, Brucella spp.
TLSRDAGMGIHFVGTAYYDGQGF

SEQ ID NO: 20461 - protein, 17 aa, Brucella spp.
AEPDAYMVLPEVISKEP

SEQ ID NO: 20462 - protein, 25 aa, Brucella spp.
DKWFNIVRWTLFALLEAEELGITQK

SEQ ID NO: 20463 - protein, 25 aa, Brucella spp.
QQLGLEPKWAYNIVASVGNYGEMFE

SEQ ID NO: 20464 - protein, 18 aa, Brucella spp.
GSLLKINRGINALWNKGG

SEQ ID NO: 20465 - protein, 21 aa, Brucella spp.
FQDSTPMLLFIGQVASDQVER

SEQ ID NO: 20466 - protein, 22 aa, Brucella spp.
FQEIDYRRMFGQMAKWVVQIDD

SEQ ID NO: 20467 - protein, 19 aa, Brucella spp.
ARIPELVSQAFHRAVNGRP

SEQ ID NO: 20468 - protein, 19 aa, Brucella spp.
ERPLMIVGGGGWTQDAVRD

SEQ ID NO: 20469 - protein, 25 aa, Brucella spp.
FAENMSLPVAASFRCQDMFDNTHPL

SEQ ID NO: 20470 - protein, 20 aa, Brucella spp.
VKDSDLLVVVGARLGEMTTQ

SEQ ID NO: 20471 - protein, 23 aa, Brucella spp.
EVQMGEVMEWLRAHLPADAIITN

SEQ ID NO: 20472 - protein, 18 aa, Brucella spp.
RTVVAFAGDGCFLMNGQE

SEQ ID NO: 20473 - protein, 22 aa, Brucella spp.
EEPELAGIYLIGPDGTPFRLGF

SEQ ID NO: 20474 - protein, 26 aa, Brucella spp.
GPDGTPFRLGFCLANEFSDHVTEKQN

SEQ ID NO: 20475 - protein, 32 aa, Brucella spp.
EHHHFKYALFRRPGDIHVHFFGTATLSFSDGV

SEQ ID NO: 20476 - protein, 22 aa, Brucella spp.
EICAKPFRYPLVNRLGQAAAEK

SEQ ID NO: 20477 - protein, 17 aa, Brucella spp.
LAIVGLGKIARDQHLPA

SEQ ID NO: 20478 - protein, 18 aa, Brucella spp.
REAAAVGPAREFLKDALI

SEQ ID NO: 20479 - protein, 18 aa, Brucella spp.
VGPAREFLKDALIRSVSV

SEQ ID NO: 20480 - protein, 20 aa, Brucella spp.
FLKDALIRSVSVAWKEDVRH

SEQ ID NO: 20481 - protein, 19 aa, Brucella spp.
DVRHWHPGQQWIWEPGGLG

SEQ ID NO: 20482 - protein, 17 aa, Brucella spp.
WHPGQQWIWEPGGLGVF

SEQ ID NO: 20483 - protein, 23 aa, Brucella spp.
PGQQWIWEPGGLGVFDPGINALS

SEQ ID NO: 20484 - protein, 17 aa, Brucella spp.
PGGLGVFDPGINALSIV

SEQ ID NO: 20485 - protein, 27 aa, Brucella spp.
FHTGSGIPVSFELDWRQTGPQTWDICV

SEQ ID NO: 20486 - protein, 19 aa, Brucella spp.
LTHVADAFLLGKRHLVEAF

SEQ ID NO: 20487 - protein, 18 aa, Brucella spp.
ALYLERYMNYGLSQEELQ

SEQ ID NO: 20488 - protein, 17 aa, Brucella spp.
LQSGRPIIGIAQTGSDL

SEQ ID NO: 20489 - protein, 17 aa, Brucella spp.
VREAGGIVIEFPVHPIQ

SEQ ID NO: 20490 - protein, 17 aa, Brucella spp.
GIVIEFPVHPIQETGKR

SEQ ID NO: 20491 - protein, 17 aa, Brucella spp.
RNLAYLGLVEVLYGYPL

SEQ ID NO: 20492 - protein, 26 aa, Brucella spp.
AYLGLVEVLYGYPLDGVVLTIGCDKT

SEQ ID NO: 20493 - protein, 23 aa, Brucella spp.
IALSVGPMLNGWFRGERTGSGTI

SEQ ID NO: 20494 - protein, 26 aa, Brucella spp.
FRGERTGSGTIVWKARELLAKGEIDY

SEQ ID NO: 20495 - protein, 17 aa, Brucella spp.
WKARELLAKGEIDYQGF

SEQ ID NO: 20496 - protein, 17 aa, Brucella spp.
RELLAKGEIDYQGFVKL

SEQ ID NO: 20497 - protein, 24 aa, Brucella spp.
LLAKGEIDYQGFVKLVASSAPSTG

SEQ ID NO: 20498 - protein, 18 aa, Brucella spp.
DRQEVAYLTGRRIVEMVH

SEQ ID NO: 20499 - protein, 25 aa, Brucella spp.
QKYGEEIPLLVNLQPAGEYLGEDYY

SEQ ID NO: 20500 - protein, 19 aa, Brucella spp.
KHAGFRVLRGNLFSSAIMK

SEQ ID NO: 20501 - protein, 19 aa, Brucella spp.
IDEHTVLFMRGAGPIGYPG

SEQ ID NO: 20502 - protein, 17 aa, Brucella spp.
AAAGGGLAILKTGDRVR

SEQ ID NO: 20503 - protein, 19 aa, Brucella spp.
RRKALEAVGGYKYPESQTP

SEQ ID NO: 20504 - protein, 17 aa, Brucella spp.
RRHVIMLPGVARQDETA

SEQ ID NO: 20505 - protein, 22 aa, Brucella spp.
ADYRTFMTGELFALLKEKSVLA

SEQ ID NO: 20506 - protein, 30 aa, Brucella spp.
LEAPELVSNRLFSIRAGWLVHDRKPTDQLA

SEQ ID NO: 20507 - protein, 23 aa, Brucella spp.
SGLLIGLEIAGGRTLYGGAKDIL

SEQ ID NO: 20508 - protein, 21 aa, Brucella spp.
KLRYPLVAILRGIRPEETEAI

SEQ ID NO: 20509 - protein, 18 aa, Brucella spp.
AIEIPLNSPAPFTSIEKA

SEQ ID NO: 20510 - protein, 19 aa, Brucella spp.
IPLNSPAPFTSIEKAAKLA

SEQ ID NO: 20511 - protein, 18 aa, Brucella spp.
ASALKFFPASVLGAEGIK

SEQ ID NO: 20512 - protein, 18 aa, Brucella spp.
AGVTCFGLGSSLYKAGFS

SEQ ID NO: 20513 - protein, 18 aa, Brucella spp.
FGLGSSLYKAGFSAADVQ

SEQ ID NO: 20514 - protein, 25 aa, Brucella spp.
NNLRESGMLLSLVAIMIFFHIVTGG

SEQ ID NO: 20515 - protein, 24 aa, Brucella spp.
VMMVKLGIPFPIAAILCLIVGGLI

SEQ ID NO: 20516 - protein, 19 aa, Brucella spp.
IAAILCLIVGGLIGAIQGF

SEQ ID NO: 20517 - protein, 30 aa, Brucella spp.
ETEPFGLFVVKCILYFVAIAYLSLLISSHR

SEQ ID NO: 20518 - protein, 22 aa, Brucella spp.
ISIFDRGFLFGDGIYEVTAVLE

SEQ ID NO: 20519 - protein, 18 aa, Brucella spp.
RSTGEIGIAMPMSEDEIV

SEQ ID NO: 20520 - protein, 24 aa, Brucella spp.
WKRRDIKTVCLLPQALTKEIAKNA

SEQ ID NO: 20521 - protein, 26 aa, Brucella spp.
NFTLPGCTRLSLLQLITETGMKLEER

SEQ ID NO: 20522 - protein, 19 aa, Brucella spp.
SVEDFDWRISMATIASDGP

SEQ ID NO: 20523 - protein, 17 aa, Brucella spp.
FSVFPGIDRTLSVLAGD

SEQ ID NO: 20524 - protein, 21 aa, Brucella spp.
TRECAPLAFAADACCDARLIG

SEQ ID NO: 20525 - protein, 18 aa, Brucella spp.
CDALPLKLTGKGTTYLIS

SEQ ID NO: 20526 - protein, 24 aa, Brucella spp.
LIPETDFDGLSIWKDGEAPTEADI

SEQ ID NO: 20527 - protein, 17 aa, Brucella spp.
ERVKAIHGVAILYDCHS

SEQ ID NO: 20528 - protein, 26 aa, Brucella spp.
DCHSIRSHIPFLFEGKLPDFNIGTDM

SEQ ID NO: 20529 - protein, 30 aa, Brucella spp.
RIALLVDPSLSFGLPAFLARKPGLNSGLMI

SEQ ID NO: 20530 - protein, 22 aa, Brucella spp.
MACHGARRLLQMTANLNAIIGI

SEQ ID NO: 20531 - protein, 18 aa, Brucella spp.
WAENVRIGIAGGVICSIE

SEQ ID NO: 20532 - protein, 32 aa, Brucella spp.
RGPSADSFWSWREIMYKFALTMTPEQAEAVAL

SEQ ID NO: 20533 - protein, 26 aa, Brucella spp.
MTPEQAEAVALRLYVDMLEAGFTRVG

SEQ ID NO: 20534 - protein, 17 aa, Brucella spp.
DMLEAGFTRVGEFHYLH

SEQ ID NO: 20535 - protein, 17 aa, Brucella spp.
LEAGFTRVGEFHYLHHD

SEQ ID NO: 20536 - protein, 17 aa, Brucella spp.
AGFTRVGEFHYLHHDCD

SEQ ID NO: 20537 - protein, 25 aa, Brucella spp.
TAGMGLTLLPVFYAHSGFGGAAANE

SEQ ID NO: 20538 - protein, 22 aa, Brucella spp.
EDCIAWSGKRPVEWLLDHQDVT

SEQ ID NO: 20539 - protein, 25 aa, Brucella spp.
PHAKGDVVLDGWIFAGRAHVCDVWV

SEQ ID NO: 20540 - protein, 25 aa, Brucella spp.
RILSGEWLPGHRIPFEHELTEYYGC

SEQ ID NO: 20541 - protein, 28 aa, Brucella spp.
IREEVAALGLPYRFELMNRWERLSGPAD

SEQ ID NO: 20542 - protein, 18 aa, Brucella spp.
ERDLAAGGILTIDLAALR

SEQ ID NO: 20543 - protein, 18 aa, Brucella spp.
LAAGGILTIDLAALRHNY

SEQ ID NO: 20544 - protein, 20 aa, Brucella spp.
PAFYEAGCRDFFVAHLGEAV

SEQ ID NO: 20545 - protein, 24 aa, Brucella spp.
AHLGEAVALKPFLKPDATLYVLNG

SEQ ID NO: 20546 - protein, 17 aa, Brucella spp.
QVENWAALATRLGKKLP

SEQ ID NO: 20547 - protein, 23 aa, Brucella spp.
RLGKKLPALLQFDTGMSRLGLSA

SEQ ID NO: 20548 - protein, 24 aa, Brucella spp.
VTLLSRIDIKFAISHLANGDEPGN

SEQ ID NO: 20549 - protein, 17 aa, Brucella spp.
HSILPVLTLSARVIQVR

SEQ ID NO: 20550 - protein, 21 aa, Brucella spp.
GDTRLPIIGRVSMDSITLDVT

SEQ ID NO: 20551 - protein, 23 aa, Brucella spp.
CDTIPYEILTALGNRYARVYVYV

SEQ ID NO: 20552 - protein, 20 aa, Brucella spp.
VTKKPFWFQLYVMRDRDFVK

SEQ ID NO: 20553 - protein, 19 aa, Brucella spp.
SALVLTLDLQILGQRHKDI

SEQ ID NO: 20554 - protein, 21 aa, Brucella spp.
MATCPAWCLGMLGTQRRTFRN

SEQ ID NO: 20555 - protein, 21 aa, Brucella spp.
QGVYIGRPFLYGLGAMGNEGV

SEQ ID NO: 20556 - protein, 21 aa, Brucella spp.
KEMDITMALCGKRDINEIDKS

SEQ ID NO: 20557 - protein, 22 aa, Brucella spp.
AVEWDEAFQAIGGILKSFDTPD

SEQ ID NO: 20558 - protein, 25 aa, Brucella spp.
RASNEAAFLYQLFVRAYGTNNFPDC

SEQ ID NO: 20559 - protein, 23 aa, Brucella spp.
FQPRLGGDLAAFRGMAKAVFAAD

SEQ ID NO: 20560 - protein, 17 aa, Brucella spp.
EAYRAAVDATSWDEIED

SEQ ID NO: 20561 - protein, 25 aa, Brucella spp.
VITIREITNFMLLRGNIGKPGAGLC

SEQ ID NO: 20562 - protein, 31 aa, Brucella spp.
INEHPPVAFLDALEREFGFKPPREPGHNVLG

SEQ ID NO: 20563 - protein, 20 aa, Brucella spp.
VPGRDSFILPCLGRTEIDLN

SEQ ID NO: 20564 - protein, 17 aa, Brucella spp.
REHIARVLPDFHDYNRR

SEQ ID NO: 20565 - protein, 29 aa, Brucella spp.
AANFRFVPYDIPRGCIAGYYPEMNVLVPL

SEQ ID NO: 20566 - protein, 25 aa, Brucella spp.
IAGYYPEMNVLVPLGSAGDESDTPT

SEQ ID NO: 20567 - protein, 17 aa, Brucella spp.
TSKSIIVSFRLNRTKAA

SEQ ID NO: 20568 - protein, 18 aa, Brucella spp.
VDYQPKLTLSGAVAARSL

SEQ ID NO: 20569 - protein, 18 aa, Brucella spp.
KLTLSGAVAARSLVNVSF

SEQ ID NO: 20570 - protein, 25 aa, Brucella spp.
VNHARIGMGVTVALLADPSIEAEGN

SEQ ID NO: 20571 - protein, 24 aa, Brucella spp.
HMDARQVIVLPWSAMASEAGRTAV

SEQ ID NO: 20572 - protein, 24 aa, Brucella spp.
SAMASEAGRTAVWRVDRDTHVATL

SEQ ID NO: 20573 - protein, 20 aa, Brucella spp.
HVATLVPIKVLAYEKERVIV

SEQ ID NO: 20574 - protein, 23 aa, Brucella spp.
RVNGEDAIGLGIGMKPNGNLLEF

SEQ ID NO: 20575 - protein, 17 aa, Brucella spp.
LPVGVKVFKVADQPQVV

SEQ ID NO: 20576 - protein, 24 aa, Brucella spp.
QALFEAVVIVLAVSFVSLGLRAGF

SEQ ID NO: 20577 - protein, 34 aa, Brucella spp.
VSLGLRAGFVVSLSIPLVLAITFLSMSLMDISLQ

SEQ ID NO: 20578 - protein, 22 aa, Brucella spp.
QAGEYTFTLFVVIAVSLLVSWV

SEQ ID NO: 20579 - protein, 18 aa, Brucella spp.
FVVIAVSLLVSWVVAVLF

SEQ ID NO: 20580 - protein, 19 aa, Brucella spp.
VSLLVSWVVAVLFAPLLGV

SEQ ID NO: 20581 - protein, 25 aa, Brucella spp.
SRFFEAFSRVLLLSMRHKWTTIITT

SEQ ID NO: 20582 - protein, 24 aa, Brucella spp.
QSDRPELVLDWTLPQNSSIADTKA

SEQ ID NO: 20583 - protein, 17 aa, Brucella spp.
QGAIRFVLSFDVQPANP

SEQ ID NO: 20584 - protein, 18 aa, Brucella spp.
GKPLGFVAILGVLALIGI

SEQ ID NO: 20585 - protein, 21 aa, Brucella spp.
ILGVLALIGILIRNSVILIVQ

SEQ ID NO: 20586 - protein, 24 aa, Brucella spp.
PIAREVFWGPMAYAMMGGIIAGTA

SEQ ID NO: 20587 - protein, 24 aa, Brucella spp.
ITLLFLPALYVAWFRIKEPEHSPD

SEQ ID NO: 20588 - protein, 23 aa, Brucella spp.
LEKEAGTFAEIARIFRKNDPAVI

SEQ ID NO: 20589 - protein, 24 aa, Brucella spp.
AATFFKYLIEIATGVPVASIGPSI

SEQ ID NO: 20590 - protein, 23 aa, Brucella spp.
GSRLKLKNGLHFTVSQSGASPDI

SEQ ID NO: 20591 - protein, 21 aa, Brucella spp.
REVVENLLFNARSLYTGGRGT

SEQ ID NO: 20592 - protein, 26 aa, Brucella spp.
MRLIEEGFPIVSFLPRDEAFDTNIAA

SEQ ID NO: 20593 - protein, 21 aa, Brucella spp.
PHLDPLVSLINYYRVIEAVTR

SEQ ID NO: 20594 - protein, 23 aa, Brucella spp.
IERLKGGVLAPGFIDAQVNGGGG

SEQ ID NO: 20595 - protein, 20 aa, Brucella spp.
ALDHPDIWCGIVADGHHVDP

SEQ ID NO: 20596 - protein, 17 aa, Brucella spp.
DAHLFLVTDAMALVGSD

SEQ ID NO: 20597 - protein, 21 aa, Brucella spp.
DLDMASAVRFAVAELELTLAE

SEQ ID NO: 20598 - protein, 32 aa, Brucella spp.
VAELELTLAEALRMASLYPARYLRLNDRGRFR

SEQ ID NO: 20599 - protein, 25 aa, Brucella spp.
LHYRAGGLAITVPILCGSIMLQDGA

SEQ ID NO: 20600 - protein, 19 aa, Brucella spp.
EGAVRPILDRYGIRDGDVL

SEQ ID NO: 20601 - protein, 20 aa, Brucella spp.
GEGDAPIYLSANMPGSGDIN

SEQ ID NO: 20602 - protein, 18 aa, Brucella spp.
LDTGRFFMRVSFISEEGV

SEQ ID NO: 20603 - protein, 20 aa, Brucella spp.
APFEMNFNFYDNAHRVKTLL

SEQ ID NO: 20604 - protein, 17 aa, Brucella spp.
RVKTLLMVSRFGHCLND

SEQ ID NO: 20605 - protein, 33 aa, Brucella spp.
FGHCLNDLLYRWKIGALPIDIVGVVSNHFDYQK

SEQ ID NO: 20606 - protein, 17 aa, Brucella spp.
IDIVGVVSNHFDYQKVV

SEQ ID NO: 20607 - protein, 18 aa, Brucella spp.
LVVLARYMQVLSDEFCQK

SEQ ID NO: 20608 - protein, 18 aa, Brucella spp.
INIHHSFLPSFKGANPYK

SEQ ID NO: 20609 - protein, 17 aa, Brucella spp.
LAADVVIVGGGFTGLST

SEQ ID NO: 20610 - protein, 21 aa, Brucella spp.
NAPKLVFEIIEKHKIACEVEK

SEQ ID NO: 20611 - protein, 21 aa, Brucella spp.
LRAGTVQPLAYVRGLAHAAIA

SEQ ID NO: 20612 - protein, 24 aa, Brucella spp.
AEVRAELVHLPYFNMATKPLSDNL

SEQ ID NO: 20613 - protein, 24 aa, Brucella spp.
WDTKEVLSSFRFDQQGRLVFGSVG

SEQ ID NO: 20614 - protein, 26 aa, Brucella spp.
SLKRLFPQIGAVEFEAEWYGKIGMTN

SEQ ID NO: 20615 - protein, 18 aa, Brucella spp.
PVERKIAAVYHIGATLPG

SEQ ID NO: 20616 - protein, 17 aa, Brucella spp.
RKIAAVYHIGATLPGDR

SEQ ID NO: 20617 - protein, 39 aa, Brucella spp.
ATLPGDRWLMEVAGWAWRVKLSLTLSLDLMRDLRERAEE

SEQ ID NO: 20618 - protein, 18 aa, Brucella spp.
TTTVYPFPPKNDVRGTQA

SEQ ID NO: 20619 - protein, 17 aa, Brucella spp.
FEQCAGFLRIPNGDEPL

SEQ ID NO: 20620 - protein, 22 aa, Brucella spp.
VDERFGLPTVRDIIAELDKPGR

SEQ ID NO: 20621 - protein, 21 aa, Brucella spp.
PRPEFKTATFADGIDDIKDLK

SEQ ID NO: 20622 - protein, 17 aa, Brucella spp.
DIKDLKPGMMLEGTVTN

SEQ ID NO: 20623 - protein, 17 aa, Brucella spp.
LKPGMMLEGTVTNVAAF

SEQ ID NO: 20624 - protein, 23 aa, Brucella spp.
TIGDLKLANRIVMAPLTRNRSPH

SEQ ID NO: 20625 - protein, 23 aa, Brucella spp.
PGLYSAEQLAGWRRVSDAVHNAG

SEQ ID NO: 20626 - protein, 20 aa, Brucella spp.
EKSELPGIVADYARAAKDAV

SEQ ID NO: 20627 - protein, 22 aa, Brucella spp.
SIENRARFLFEVVDAVTKAIGA

SEQ ID NO: 20628 - protein, 21 aa, Brucella spp.
KLAACGLAYIHIIEGATGGPR

SEQ ID NO: 20629 - protein, 18 aa, Brucella spp.
QVYRDAGGKAAWMVNNGY

SEQ ID NO: 20630 - protein, 20 aa, Brucella spp.
AGRADLVAFGKPFIANPDLV

SEQ ID NO: 20631 - protein, 25 aa, Brucella spp.
NHAIKALPYAVAWIEAISEAAYRES

SEQ ID NO: 20632 - protein, 25 aa, Brucella spp.
AYRESAEGFPIFLGGDHLLAAGTVP

SEQ ID NO: 20633 - protein, 18 aa, Brucella spp.
AEKGRKQFVLWLDAHTDF

SEQ ID NO: 20634 - protein, 18 aa, Brucella spp.
RKQFVLWLDAHTDFHTLE

SEQ ID NO: 20635 - protein, 24 aa, Brucella spp.
LIDEHGVAALLRRFLERVKAEDGL

SEQ ID NO: 20636 - protein, 20 aa, Brucella spp.
MKLVLRVGVETFLKELAGYV

SEQ ID NO: 20637 - protein, 24 aa, Brucella spp.
PMLLTEMTILTALRTAATSAVAAK

SEQ ID NO: 20638 - protein, 21 aa, Brucella spp.
SEFQALAFKAILGVDKLRLYD

SEQ ID NO: 20639 - protein, 25 aa, Brucella spp.
LPEDYPVNELWEVITGRIAGRKDAR

SEQ ID NO: 20640 - protein, 17 aa, Brucella spp.
VEHPPLFTVADSQNLRG

SEQ ID NO: 20641 - protein, 19 aa, Brucella spp.
GLMKYDIINGHPLTNEATT

SEQ ID NO: 20642 - protein, 31 aa, Brucella spp.
ADIPDVVPVFPLKGALLLPGGQLPLNIFEPR

SEQ ID NO: 20643 - protein, 21 aa, Brucella spp.
GDGRLLITLQGICRFRVQEEL

SEQ ID NO: 20644 - protein, 20 aa, Brucella spp.
YEVRPEGGLLRLRKDMQLYA

SEQ ID NO: 20645 - protein, 18 aa, Brucella spp.
YANLRPAICYPALAHSSS

SEQ ID NO: 20646 - protein, 28 aa, Brucella spp.
LKPEVIEGLDILILRELTGGVYFGEPKE

SEQ ID NO: 20647 - protein, 21 aa, Brucella spp.
LRELTGGVYFGEPKEIIDLGN

SEQ ID NO: 20648 - protein, 26 aa, Brucella spp.
GMQLVRWPKQFDVILTDNLFGDLLSD

SEQ ID NO: 20649 - protein, 19 aa, Brucella spp.
PIAMIASLAMCLRYSFGLV

SEQ ID NO: 20650 - protein, 26 aa, Brucella spp.
IASLAMCLRYSFGLVAEADRLEAAIA

SEQ ID NO: 20651 - protein, 17 aa, Brucella spp.
AAIAGVLDDGIRTADIW

SEQ ID NO: 20652 - protein, 17 aa, Brucella spp.
VIFASSLGTVFEWYDFY

SEQ ID NO: 20653 - protein, 25 aa, Brucella spp.
LGTVFEWYDFYLYGTLASFIGAAFF

SEQ ID NO: 20654 - protein, 25 aa, Brucella spp.
YPEATRNIFVLLAFAAGFVVRPFGA

SEQ ID NO: 20655 - protein, 32 aa, Brucella spp.
LLSKDAFAAWGWRIPFLVSVLLLGISVWIRMQ

SEQ ID NO: 20656 - protein, 17 aa, Brucella spp.
AKIALIALFGLTAGQAV

SEQ ID NO: 20657 - protein, 24 aa, Brucella spp.
VVWYCGQFYALFFLQNVLKVENQS

SEQ ID NO: 20658 - protein, 23 aa, Brucella spp.
LIGTGFFVIFGWLSDKIGRKPII

SEQ ID NO: 20659 - protein, 25 aa, Brucella spp.
TGMSLPYHIGNGWFGGLLPAGVFAL

SEQ ID NO: 20660 - protein, 19 aa, Brucella spp.
GDIYYGLWYPIIIASVTFV

SEQ ID NO: 20661 - protein, 20 aa, Brucella spp.
FPADEVVPLASRRSQGTEVS

SEQ ID NO: 20662 - protein, 22 aa, Brucella spp.
FTKRIAFNVIPHIDVFMEDGYT

SEQ ID NO: 20663 - protein, 24 aa, Brucella spp.
EDITVENGLAMWVVSDNLRKGAAL

SEQ ID NO: 20664 - protein, 30 aa, Brucella spp.
EQLFASGYAACFLGALKFAAAKEKISIPAE

SEQ ID NO: 20665 - protein, 27 aa, Brucella spp.
EDGTGFGLDVALSIALPGIDKAKAEEL

SEQ ID NO: 20666 - protein, 19 aa, Brucella spp.
RTGLGKGLFAEMRFNEDGS

SEQ ID NO: 20667 - protein, 26 aa, Brucella spp.
SREHAPWALLDYGIRCVISTSFADIF

SEQ ID NO: 20668 - protein, 21 aa, Brucella spp.
YGIRCVISTSFADIFYNNCFK

SEQ ID NO: 20669 - protein, 17 aa, Brucella spp.
ISTSFADIFYNNCFKNG

SEQ ID NO: 20670 - protein, 20 aa, Brucella spp.
FYNNCFKNGILPIKVAQEDL

SEQ ID NO: 20671 - protein, 17 aa, Brucella spp.
DDFKRHCLLNGLDDIGL

SEQ ID NO: 20672 - protein, 19 aa, Brucella spp.
FKRHCLLNGLDDIGLTMEK

SEQ ID NO: 20673 - protein, 18 aa, Brucella spp.
GITILAKATSVVWKNTRI

SEQ ID NO: 20674 - protein, 19 aa, Brucella spp.
PMPQTKFVVGKALKVGLKP

SEQ ID NO: 20675 - protein, 26 aa, Brucella spp.
ATDEQLDFPILYGSGRNGWMALSPEG

SEQ ID NO: 20676 - protein, 24 aa, Brucella spp.
GPKDQGLAPLFDLVLKHVPAPKVA

SEQ ID NO: 20677 - protein, 23 aa, Brucella spp.
APKVAEGPFRMIGTILEADPFLG

SEQ ID NO: 20678 - protein, 22 aa, Brucella spp.
ILEADPFLGRIITGRIHSGSIK

SEQ ID NO: 20679 - protein, 21 aa, Brucella spp.
ENGRISKILAFRGIERQAIDE

SEQ ID NO: 20680 - protein, 23 aa, Brucella spp.
SGRGELQLAVLIENMRREGFELG

SEQ ID NO: 20681 - protein, 19 aa, Brucella spp.
NRVRLVFYAPTRGLIGYQS

SEQ ID NO: 20682 - protein, 23 aa, Brucella spp.
IEAGVKVYQGMLIGIHSRDNDLE

SEQ ID NO: 20683 - protein, 28 aa, Brucella spp.
VKLTPPIKMTLERALSWIQDDELVEVTP

SEQ ID NO: 20684 - protein, 23 aa, Brucella spp.
FSQEIKKSRFLAIAAPVASEEAA

SEQ ID NO: 20685 - protein, 20 aa, Brucella spp.
VVVVTRWFGGILLGSGGLMR

SEQ ID NO: 20686 - protein, 24 aa, Brucella spp.
AEKTEVIALVGFALACDFSDHALL

SEQ ID NO: 20687 - protein, 20 aa, Brucella spp.
EMTGAMPIAAKDDLSRLVSD

SEQ ID NO: 20688 - protein, 24 aa, Brucella spp.
DLGFSVGEGVIFATLDPVSGQFHI

SEQ ID NO: 20689 - protein, 18 aa, Brucella spp.
RTSDLAFNASVQRHLSAG

SEQ ID NO: 20690 - protein, 22 aa, Brucella spp.
GPRGRNFNMRWLGAAVGDMHRI

SEQ ID NO: 20691 - protein, 18 aa, Brucella spp.
MQRGGLFFYVNDSRPGYE

SEQ ID NO: 20692 - protein, 23 aa, Brucella spp.
RLVYEANPIAFLAREAGGKATDG

SEQ ID NO: 20693 - protein, 21 aa, Brucella spp.
TEIYPHIPVCVHLDHGNEAAT

SEQ ID NO: 20694 - protein, 22 aa, Brucella spp.
SVEGELGVLGSLETGMGDVEDA

SEQ ID NO: 20695 - protein, 21 aa, Brucella spp.
YGGQMKPTWGVPVEEIQRGIK

SEQ ID NO: 20696 - protein, 18 aa, Brucella spp.
RMAMTGQIRRILQEEPSE

SEQ ID NO: 20697 - protein, 19 aa, Brucella spp.
EFDPRKYLKPAMAAMTKLC

SEQ ID NO: 20698 - protein, 17 aa, Brucella spp.
HLKDRFEVSEISRTDAG

SEQ ID NO: 20699 - protein, 22 aa, Brucella spp.
GVCIAANKVPGIRAALTHDTYS

SEQ ID NO: 20700 - protein, 18 aa, Brucella spp.
KTIADAFLAQTFDENGRS

SEQ ID NO: 20701 - protein, 17 aa, Brucella spp.
ALRAAWLHFVAGMTQSA

SEQ ID NO: 20702 - protein, 17 aa, Brucella spp.
LENRLADLYGLDYCEVA

SEQ ID NO: 20703 - protein, 17 aa, Brucella spp.
LADLYGLDYCEVAPDIG

SEQ ID NO: 20704 - protein, 24 aa, Brucella spp.
DIGEEGLPLMALGHAGANFMRREI

SEQ ID NO: 20705 - protein, 21 aa, Brucella spp.
RVMANDLRFVSLLGGLTRNFA

SEQ ID NO: 20706 - protein, 20 aa, Brucella spp.
LRFVSLLGGLTRNFAANPHD

SEQ ID NO: 20707 - protein, 23 aa, Brucella spp.
TGMPAYMMPVPFFANTAEDREVL

SEQ ID NO: 20708 - protein, 18 aa, Brucella spp.
LRYLEYYEFRLVREALIE

SEQ ID NO: 20709 - protein, 26 aa, Brucella spp.
LNAAPHIIWPMRFVLPHSPQDRPAWL

SEQ ID NO: 20710 - protein, 26 aa, Brucella spp.
SPQDRPAWLVRLGLFLYDHLGGRKKL

SEQ ID NO: 20711 - protein, 19 aa, Brucella spp.
SHIIVPKFWSGANAYLVQN

SEQ ID NO: 20712 - protein, 17 aa, Brucella spp.
IDYLITAVNRYFKEKLR

SEQ ID NO: 20713 - protein, 21 aa, Brucella spp.
DETGGAPLLNVFGGKITTFRE

SEQ ID NO: 20714 - protein, 20 aa, Brucella spp.
LRDTYPWMPRTLVHHYGRLY

SEQ ID NO: 20715 - protein, 24 aa, Brucella spp.
KDNRPVGDAWIWLDARAASTVTRL

SEQ ID NO: 20716 - protein, 22 aa, Brucella spp.
AALHCKDWLYLNLTGVRATDPS

SEQ ID NO: 20717 - protein, 18 aa, Brucella spp.
SEASFTFGNFRTRQYDDV

SEQ ID NO: 20718 - protein, 17 aa, Brucella spp.
LSAEAAAATGLLAGTPV

SEQ ID NO: 20719 - protein, 17 aa, Brucella spp.
TGYVIALPIPGIVTQVQ

SEQ ID NO: 20720 - protein, 25 aa, Brucella spp.
QTNMGATINIDWILQVAADLMSTPE

SEQ ID NO: 20721 - protein, 20 aa, Brucella spp.
DLIPRLDDWFNASRPGAILY

SEQ ID NO: 20722 - protein, 19 aa, Brucella spp.
SRDRFPELVRSVVEGLGMA

SEQ ID NO: 20723 - protein, 19 aa, Brucella spp.
FPELVRSVVEGLGMATRDC

SEQ ID NO: 20724 - protein, 24 aa, Brucella spp.
MGEMPAELRITGGAARSKALRGTL

SEQ ID NO: 20725 - protein, 18 aa, Brucella spp.
RAALWSVIAAVVVIGAIG

SEQ ID NO: 20726 - protein, 17 aa, Brucella spp.
IAAVVVIGAIGFDTKVV

SEQ ID NO: 20727 - protein, 21 aa, Brucella spp.
VNPVIPVKFTGTVEERKANYN

SEQ ID NO: 20728 - protein, 18 aa, Brucella spp.
PEGMVIRVQTGPAVNGTE

SEQ ID NO: 20729 - protein, 19 aa, Brucella spp.
DATGEIQFGQFKNQIEYQN

SEQ ID NO: 20730 - protein, 21 aa, Brucella spp.
VEIARALSVNSRILIMDEPTS

SEQ ID NO: 20731 - protein, 24 aa, Brucella spp.
SASEVEVLFKVIRDLTARGVAIVY

SEQ ID NO: 20732 - protein, 19 aa, Brucella spp.
IRDLTARGVAIVYISHHLE

SEQ ID NO: 20733 - protein, 19 aa, Brucella spp.
TARGVAIVYISHHLEEALQ

SEQ ID NO: 20734 - protein, 22 aa, Brucella spp.
APREEIDLEWIVRNMVGENFDL

SEQ ID NO: 20735 - protein, 17 aa, Brucella spp.
PPTGYEWGDVALSVEDL

SEQ ID NO: 20736 - protein, 24 aa, Brucella spp.
PSGSGFSLVDRMSLNVRAGEIVCI

SEQ ID NO: 20737 - protein, 26 aa, Brucella spp.
LNVRAGEIVCIYGLMGAGRTELLESV

SEQ ID NO: 20738 - protein, 18 aa, Brucella spp.
GQDISGLTIAERIEKGLV

SEQ ID NO: 20739 - protein, 17 aa, Brucella spp.
TIAERIEKGLVLVPEDR

SEQ ID NO: 20740 - protein, 24 aa, Brucella spp.
SEVGECLSIAHRIIVMHRGRISAE

SEQ ID NO: 20741 - protein, 27 aa, Brucella spp.
VHLLLEGRAFFALIAIIAVFSFLSPYY

SEQ ID NO: 20742 - protein, 26 aa, Brucella spp.
VTLQEFGIILYFPVWAVVLITCALGA

SEQ ID NO: 20743 - protein, 17 aa, Brucella spp.
IAYLRVPAFVATLGVLY

SEQ ID NO: 20744 - protein, 22 aa, Brucella spp.
GNTGFDWLGFNKLFGVPIGVLV

SEQ ID NO: 20745 - protein, 21 aa, Brucella spp.
KKTAEGLGYKAVVGGHKGDTN

SEQ ID NO: 20746 - protein, 24 aa, Brucella spp.
AVKRAIAANIPVFLINAEINQEGL

SEQ ID NO: 20747 - protein, 19 aa, Brucella spp.
VGDKGKYVELFGAPSDNNA

SEQ ID NO: 20748 - protein, 17 aa, Brucella spp.
TVLSQYPDLVRVGKDVA

SEQ ID NO: 20749 - protein, 17 aa, Brucella spp.
DLVRVGKDVANWDRTQG

SEQ ID NO: 20750 - protein, 21 aa, Brucella spp.
NDEMALGAIAALKKAGKLDQV

SEQ ID NO: 20751 - protein, 21 aa, Brucella spp.
GELQYTVLQPVAVFSEAAVKQ

SEQ ID NO: 20752 - protein, 23 aa, Brucella spp.
VQGDDVVAIISWRESDDATNTLF

SEQ ID NO: 20753 - protein, 29 aa, Brucella spp.
IHSRIWLDRPEIIRWFQIIGYHENGNENG

SEQ ID NO: 20754 - protein, 20 aa, Brucella spp.
QEHELPFWLQATPDDIAGLE

SEQ ID NO: 20755 - protein, 24 aa, Brucella spp.
QVLRARLCDLCWLLERKRHQLGRA

SEQ ID NO: 20756 - protein, 32 aa, Brucella spp.
LRRALSMGRPLGWDIDEVIAARTLLSAIRARA

SEQ ID NO: 20757 - protein, 32 aa, Brucella spp.
VRSSNPVPVHWFFEMDLDFGISDPSIIAAEIE

SEQ ID NO: 20758 - protein, 20 aa, Brucella spp.
EPGSHMIVELWRLAARGHHY

SEQ ID NO: 20759 - protein, 24 aa, Brucella spp.
EGERDLIDLLLIFADLEQSPSPKK

SEQ ID NO: 20760 - protein, 18 aa, Brucella spp.
HPLSSLFGASFHDHEGKV

SEQ ID NO: 20761 - protein, 23 aa, Brucella spp.
FEGDCVSALYILTPMLENSLRHI

SEQ ID NO: 20762 - protein, 19 aa, Brucella spp.
NSLRHILKLNGYDVTTFDD

SEQ ID NO: 20763 - protein, 30 aa, Brucella spp.
PYGTDAIYACWLIFRLCCIPLFEQRERLRL

SEQ ID NO: 20764 - protein, 20 aa, Brucella spp.
RNEDAGLISPMYTVFETNSE

SEQ ID NO: 20765 - protein, 20 aa, Brucella spp.
INNEIALRQFKRFALSGRFD

SEQ ID NO: 20766 - protein, 20 aa, Brucella spp.
ALRQFKRFALSGRFDPYSNG

SEQ ID NO: 20767 - protein, 17 aa, Brucella spp.
ILFSDLSAFKFGLPPLT

SEQ ID NO: 20768 - protein, 19 aa, Brucella spp.
DLSAFKFGLPPLTEQRAIA

SEQ ID NO: 20769 - protein, 18 aa, Brucella spp.
QQSLLWSCVAKMGRWLSG

SEQ ID NO: 20770 - protein, 20 aa, Brucella spp.
SCVAKMGRWLSGGTPATAAE

SEQ ID NO: 20771 - protein, 25 aa, Brucella spp.
AAEENWKGSIPWVCPKDIKGPSISS

SEQ ID NO: 20772 - protein, 26 aa, Brucella spp.
FVPNEGVAPAFLKLWLDINEHKLLGE

SEQ ID NO: 20773 - protein, 26 aa, Brucella spp.
TKRFPLERLNEFPVPVVTRDEQIRLV

SEQ ID NO: 20774 - protein, 26 aa, Brucella spp.
DSSDYKIYIFGFLFLKRLSDRFEEEA

SEQ ID NO: 20775 - protein, 19 aa, Brucella spp.
FLVERARWSSIKKLTTGIG

SEQ ID NO: 20776 - protein, 23 aa, Brucella spp.
KNREGVLSRLIDHFSRIDLSNAS

SEQ ID NO: 20777 - protein, 17 aa, Brucella spp.
DQDGNLFLYDRVIANPP

SEQ ID NO: 20778 - protein, 20 aa, Brucella spp.
GVVMPHGVLFRGSGDGRIRE

SEQ ID NO: 20779 - protein, 23 aa, Brucella spp.
RESMLKADLFEAIIGLPENLFAG

SEQ ID NO: 20780 - protein, 19 aa, Brucella spp.
RKGRVLFIHGAKEFEERPK

SEQ ID NO: 20781 - protein, 19 aa, Brucella spp.
GNITRIVNAFNAWKDEDRF

SEQ ID NO: 20782 - protein, 22 aa, Brucella spp.
RLLDVAEIFAGVGVSREETVIR

SEQ ID NO: 20783 - protein, 25 aa, Brucella spp.
TVIRPGERLPVIGVRDLQDGVVAPR

SEQ ID NO: 20784 - protein, 19 aa, Brucella spp.
RGTLLKFGLVGDETAGAVA

SEQ ID NO: 20785 - protein, 19 aa, Brucella spp.
GGALFAILSSDVFRPKIEV

SEQ ID NO: 20786 - protein, 24 aa, Brucella spp.
DRLRIPVVGAPLFIISHPALVLAQ

SEQ ID NO: 20787 - protein, 22 aa, Brucella spp.
NARPEAQLDEWLAEITEDLAAY

SEQ ID NO: 20788 - protein, 28 aa, Brucella spp.
LEHDLGLCVKYKVPIVISSLGAVPEVNA

SEQ ID NO: 20789 - protein, 17 aa, Brucella spp.
KETIWLSTFGLLSNQKA

SEQ ID NO: 20790 - protein, 29 aa, Brucella spp.
HSPFYSYGIPALVLLVAVMIGYSLYNSLS

SEQ ID NO: 20791 - protein, 26 aa, Brucella spp.
KEGEEPGGAKWINIFLPDEATRISVQ

SEQ ID NO: 20792 - protein, 25 aa, Brucella spp.
NESLNDFLFDMDFSASRKPGGAGTI

SEQ ID NO: 20793 - protein, 26 aa, Brucella spp.
ATFLLPDRFVKWFAAKGWSPRAHQLE

SEQ ID NO: 20794 - protein, 21 aa, Brucella spp.
SKRGHLLALGLARLRRLQPQL

SEQ ID NO: 20795 - protein, 22 aa, Brucella spp.
SQAEMLFQELWRVNEETLPIAL

SEQ ID NO: 20796 - protein, 22 aa, Brucella spp.
RVNEETLPIALHHGSLDAGQRR

SEQ ID NO: 20797 - protein, 19 aa, Brucella spp.
PSRAILVPANRFEVMECRA

SEQ ID NO: 20798 - protein, 22 aa, Brucella spp.
PRDTFDRILDFVATGGYALKTY

SEQ ID NO: 20799 - protein, 19 aa, Brucella spp.
TAGDTFLFAGKVLRFEGIR

SEQ ID NO: 20800 - protein, 18 aa, Brucella spp.
YAGGKFPLSTYLAAQVRA

SEQ ID NO: 20801 - protein, 18 aa, Brucella spp.
FPLSTYLAAQVRAMLADR

SEQ ID NO: 20802 - protein, 23 aa, Brucella spp.
QVREWLEVQQWKSVLPGTDELLI

SEQ ID NO: 20803 - protein, 18 aa, Brucella spp.
IETFPRGNRFYMVAYPFE

SEQ ID NO: 20804 - protein, 22 aa, Brucella spp.
FPRGNRFYMVAYPFEGRLAHQT

SEQ ID NO: 20805 - protein, 22 aa, Brucella spp.
LAHQTLGMLLTRRLERMGAHPL

SEQ ID NO: 20806 - protein, 24 aa, Brucella spp.
TRRLERMGAHPLGFVTTDYSLGLW

SEQ ID NO: 20807 - protein, 18 aa, Brucella spp.
MIRMGRLNLSRLFDEDML

SEQ ID NO: 20808 - protein, 23 aa, Brucella spp.
LDQISPLALPVMLEIGRERVAGE

SEQ ID NO: 20809 - protein, 17 aa, Brucella spp.
LPVMLEIGRERVAGEGD

SEQ ID NO: 20810 - protein, 21 aa, Brucella spp.
RTLDIKLGLFLVAGGILGSLI

SEQ ID NO: 20811 - protein, 19 aa, Brucella spp.
PVLGIGFFIGLLSSVMGVG

SEQ ID NO: 20812 - protein, 23 aa, Brucella spp.
NQSIDIVLAFLLMVGGVIGAQYG

SEQ ID NO: 20813 - protein, 22 aa, Brucella spp.
RGEQLRLLLALLVLAVGMRLAF

SEQ ID NO: 20814 - protein, 21 aa, Brucella spp.
RLNEISRALIATNKLQRPSRE

SEQ ID NO: 20815 - protein, 19 aa, Brucella spp.
TESVVARMLQHGPKSETAI

SEQ ID NO: 20816 - protein, 18 aa, Brucella spp.
ETAIAQQLAADMKALETL

SEQ ID NO: 20817 - protein, 19 aa, Brucella spp.
LAADMKALETLARNADDRN

SEQ ID NO: 20818 - protein, 17 aa, Brucella spp.
MKALETLARNADDRNTK

SEQ ID NO: 20819 - protein, 22 aa, Brucella spp.
PHEPFFKSDFASLKPARRENPV

SEQ ID NO: 20820 - protein, 18 aa, Brucella spp.
ATSKVDFITAARRAAQLA

SEQ ID NO: 20821 - protein, 24 aa, Brucella spp.
LHRQRKPILFAIGAVMIAIAGLQV

SEQ ID NO: 20822 - protein, 17 aa, Brucella spp.
AIAGLQVGTAFLNRDSD

SEQ ID NO: 20823 - protein, 17 aa, Brucella spp.
AGLQVGTAFLNRDSDID

SEQ ID NO: 20824 - protein, 17 aa, Brucella spp.
LQVGTAFLNRDSDIDPA

SEQ ID NO: 20825 - protein, 24 aa, Brucella spp.
AAAKGDIRALFEIGNRYMEGRGVA

SEQ ID NO: 20826 - protein, 25 aa, Brucella spp.
ENVKEAAKWYQLAADQGFAPAQYRI

SEQ ID NO: 20827 - protein, 17 aa, Brucella spp.
AADQGFAPAQYRIGSFN

SEQ ID NO: 20828 - protein, 18 aa, Brucella spp.
FAPAQYRIGSFNEKGLGM

SEQ ID NO: 20829 - protein, 18 aa, Brucella spp.
FNEKGLGMARNLEKAKSW

SEQ ID NO: 20830 - protein, 25 aa, Brucella spp.
GLGMARNLEKAKSWYQLAADQGNAS

SEQ ID NO: 20831 - protein, 19 aa, Brucella spp.
NAAAVRWFTEAAELGVKDS

SEQ ID NO: 20832 - protein, 40 aa, Brucella spp.
SQYNLGILAAKGLGMPVNLEESYKWFALAANAGDKDAAEK

SEQ ID NO: 20833 - protein, 25 aa, Brucella spp.
EMLTRAKGAVKLWKAKPLDDAANSI

SEQ ID NO: 20834 - protein, 17 aa, Brucella spp.
AANSIDVPDAWTEAKPL

SEQ ID NO: 20835 - protein, 20 aa, Brucella spp.
AGATVLRGPLGFGHSSILHT

SEQ ID NO: 20836 - protein, 18 aa, Brucella spp.
LRGPLGFGHSSILHTAKI

SEQ ID NO: 20837 - protein, 17 aa, Brucella spp.
TGIAHLGIGAFHRAHQA

SEQ ID NO: 20838 - protein, 25 aa, Brucella spp.
ISISRTLKVLDQWPITTEPFSQWVI

SEQ ID NO: 20839 - protein, 18 aa, Brucella spp.
ITTEPFSQWVIEDRFPTG

SEQ ID NO: 20840 - protein, 17 aa, Brucella spp.
RPAWEIAGATFVQDVAA

SEQ ID NO: 20841 - protein, 23 aa, Brucella spp.
VAAFELMKLRLLNGSHSTLAYLG

SEQ ID NO: 20842 - protein, 23 aa, Brucella spp.
NGSHSTLAYLGFLAGHRTVSQTT

SEQ ID NO: 20843 - protein, 20 aa, Brucella spp.
IKALMEIEIAPTLPKLEGFD

SEQ ID NO: 20844 - protein, 20 aa, Brucella spp.
IEIAPTLPKLEGFDLSSYQA

SEQ ID NO: 20845 - protein, 21 aa, Brucella spp.
LLALGVAAWMRYVTGKDEAGT

SEQ ID NO: 20846 - protein, 25 aa, Brucella spp.
FAPDEIMDALLSFRQIFTARLAANE

SEQ ID NO: 20847 - protein, 17 aa, Brucella spp.
EKLRLALGSLYAVGSAE

SEQ ID NO: 20848 - protein, 21 aa, Brucella spp.
LPSEHAHQFSIDIEEHGMVPD

SEQ ID NO: 20849 - protein, 25 aa, Brucella spp.
YAKHPNFGGVLLIGLGCETNQIAPI

SEQ ID NO: 20850 - protein, 19 aa, Brucella spp.
TPEIYGAEHLLTRRAVTPA

SEQ ID NO: 20851 - protein, 24 aa, Brucella spp.
VAEKLLQRIDWWRDYTARNGDELN

SEQ ID NO: 20852 - protein, 23 aa, Brucella spp.
GGSMPLKAVYEFAETITEQGFVF

SEQ ID NO: 20853 - protein, 17 aa, Brucella spp.
GCNVICFTTGRGSVSGF

SEQ ID NO: 20854 - protein, 19 aa, Brucella spp.
EEAGARIFDHILAVASGQK

SEQ ID NO: 20855 - protein, 18 aa, Brucella spp.
LILAFAFVSVAFVSGAHA

SEQ ID NO: 20856 - protein, 23 aa, Brucella spp.
HADPKLNFSWPVNVGPLNPHLYS

SEQ ID NO: 20857 - protein, 21 aa, Brucella spp.
TVGPWLAESWEAFQDGRSYTF

SEQ ID NO: 20858 - protein, 19 aa, Brucella spp.
VVGPYKVRINLKKPYYPLL

SEQ ID NO: 20859 - protein, 27 aa, Brucella spp.
YPLLQELSLPRPFRFIAPSQFKNGGTA

SEQ ID NO: 20860 - protein, 21 aa, Brucella spp.
FEAGEIDLIYGTEGPISPDTF

SEQ ID NO: 20861 - protein, 23 aa, Brucella spp.
DGQPLAIELCFIGTDAISKSMAE

SEQ ID NO: 20862 - protein, 17 aa, Brucella spp.
AVYLPLTSVTAMAVAKP

SEQ ID NO: 20863 - protein, 25 aa, Brucella spp.
VSMPNFWLGFLLVLVFSIQLGWLPP

SEQ ID NO: 20864 - protein, 18 aa, Brucella spp.
SIFGWPGVGRYAVSAILN

SEQ ID NO: 20865 - protein, 28 aa, Brucella spp.
PRQWPVRLACIIVLLLLVAAVAGPWITP

SEQ ID NO: 20866 - protein, 20 aa, Brucella spp.
WEHLLPATFSQLVVLATLDV

SEQ ID NO: 20867 - protein, 25 aa, Brucella spp.
QFVWTAPMLILWPGLALFLSVMAFN

SEQ ID NO: 20868 - protein, 20 aa, Brucella spp.
ICIARALAVNPKLIILDEAV

SEQ ID NO: 20869 - protein, 24 aa, Brucella spp.
KLQQEGGIAYLFVTHDLRLVQKFA

SEQ ID NO: 20870 - protein, 18 aa, Brucella spp.
VTHDLRLVQKFAARCLVM

SEQ ID NO: 20871 - protein, 17 aa, Brucella spp.
AAFEAGYDFKAPGIQIS

SEQ ID NO: 20872 - protein, 25 aa, Brucella spp.
WYMDPSVGFPGYFMPQGVSADLIAT

SEQ ID NO: 20873 - protein, 18 aa, Brucella spp.
VMPGEMGGFNAVGIQAHP

SEQ ID NO: 20874 - protein, 32 aa, Brucella spp.
ISDIDLFELNEAFAAVVLRYMQAFDIPHDKIN

SEQ ID NO: 20875 - protein, 22 aa, Brucella spp.
AMGHPLGATGAMILGTVLDELE

SEQ ID NO: 20876 - protein, 18 aa, Brucella spp.
ETDADGIALVTWDMPEKS

SEQ ID NO: 20877 - protein, 21 aa, Brucella spp.
KLETCGKPWVSAINGTCMGGA

SEQ ID NO: 20878 - protein, 22 aa, Brucella spp.
ALPEVKVGLFPGAGGTQRVPRL

SEQ ID NO: 20879 - protein, 18 aa, Brucella spp.
GLVTEIAPAKKLVETAKK

SEQ ID NO: 20880 - protein, 19 aa, Brucella spp.
RLKKIGVIGAGFMGAGIAY

SEQ ID NO: 20881 - protein, 25 aa, Brucella spp.
VSKRPKNFIGIHFFSPVDKMMLVEV

SEQ ID NO: 20882 - protein, 22 aa, Brucella spp.
TSDKALAVALDYVRAIKKTPIV

SEQ ID NO: 20883 - protein, 27 aa, Brucella spp.
DVKELKERFLVTIALEAARVMEEGIVT

SEQ ID NO: 20884 - protein, 26 aa, Brucella spp.
DPREADVGSILAFGFAPYTGGTLSYI

SEQ ID NO: 20885 - protein, 18 aa, Brucella spp.
HAHFVFGSLACLTGAVLI

SEQ ID NO: 20886 - protein, 29 aa, Brucella spp.
FGSLACLTGAVLIAAFVAPFYGALDRRVV

SEQ ID NO: 20887 - protein, 18 aa, Brucella spp.
REAPRPPLSDLGLASTPK

SEQ ID NO: 20888 - protein, 32 aa, Brucella spp.
SGESWPCGMQARTAFRQWLRSRAVMCRLPEND

SEQ ID NO: 20889 - protein, 23 aa, Brucella spp.
LGNEDAAAWLVANGWAKAVPGGT

SEQ ID NO: 20890 - protein, 19 aa, Brucella spp.
AALEPYLQMPLSSVPNPFG

SEQ ID NO: 20891 - protein, 18 aa, Brucella spp.
PYLQMPLSSVPNPFGGDY

SEQ ID NO: 20892 - protein, 24 aa, Brucella spp.
NAMLCRFLDTFGFDYEFASATEYY

SEQ ID NO: 20893 - protein, 26 aa, Brucella spp.
VKLQWKPDFGMRWAALGVDFEMFGKD

SEQ ID NO: 20894 - protein, 17 aa, Brucella spp.
HFVYELFLDQLGQKISK

SEQ ID NO: 20895 - protein, 24 aa, Brucella spp.
PPKADLPVTFALMLNLVSASNAES

SEQ ID NO: 20896 - protein, 22 aa, Brucella spp.
AESPAVLWGFISRHVPGVTPEN

SEQ ID NO: 20897 - protein, 24 aa, Brucella spp.
NPELDALVGYAIRYFNDFVKPTKK

SEQ ID NO: 20898 - protein, 24 aa, Brucella spp.
QERGPRFGSFVALYGIDETRALIK

SEQ ID NO: 20899 - protein, 21 aa, Brucella spp.
KITRISVVFRRLWNCTDTVPR

SEQ ID NO: 20900 - protein, 26 aa, Brucella spp.
GCGNMGFAMLRGWLDSGILKAGDVHV

SEQ ID NO: 20901 - protein, 24 aa, Brucella spp.
DLPADLQPRMVLVAVKPQMMANVL

SEQ ID NO: 20902 - protein, 17 aa, Brucella spp.
MMANVLPAYKRFAPAST

SEQ ID NO: 20903 - protein, 20 aa, Brucella spp.
VLPAYKRFAPASTFVSVAAG

SEQ ID NO: 20904 - protein, 18 aa, Brucella spp.
PAYIFHFIEALTDAGVNL

SEQ ID NO: 20905 - protein, 23 aa, Brucella spp.
GLPRETAALLAMQTVMGAGALAD

SEQ ID NO: 20906 - protein, 26 aa, Brucella spp.
DPAIHGILVQLPLPGHIDSGRVIQTI

SEQ ID NO: 20907 - protein, 22 aa, Brucella spp.
EKDVDGFHFINVGKLGTGEVET

SEQ ID NO: 20908 - protein, 18 aa, Brucella spp.
CTPAGAMIMIERVHGRDL

SEQ ID NO: 20909 - protein, 18 aa, Brucella spp.
IVGKPMFNLLLAANATVT

SEQ ID NO: 20910 - protein, 20 aa, Brucella spp.
RPQMVKGDWVKPGATVIDVG

SEQ ID NO: 20911 - protein, 19 aa, Brucella spp.
RSFLGCANLAHGFAACGPH

SEQ ID NO: 20912 - protein, 23 aa, Brucella spp.
CDKIVPGLIVGALTFGHLPPVFI

SEQ ID NO: 20913 - protein, 22 aa, Brucella spp.
LTFGHLPPVFIPAGPMTSGLPN

SEQ ID NO: 20914 - protein, 18 aa, Brucella spp.
AAGIKLTWHDISQISDVV

SEQ ID NO: 20915 - protein, 28 aa, Brucella spp.
NHFHAAGGMGFLIRELLDGGLLHEDVRT

SEQ ID NO: 20916 - protein, 19 aa, Brucella spp.
AGDLTGDFIAVVRYQGPKA

SEQ ID NO: 20917 - protein, 25 aa, Brucella spp.
NGMPELHKLMTVLGILQDRGQRVAL

SEQ ID NO: 20918 - protein, 25 aa, Brucella spp.
GNEYGMGRELFRAFRQIAGRADEGA

SEQ ID NO: 20919 - protein, 21 aa, Brucella spp.
LRDHAGVARFVGLYNPAATAE

SEQ ID NO: 20920 - protein, 23 aa, Brucella spp.
GEKRLTLTLPLIAEAEMLVLHIE

SEQ ID NO: 20921 - protein, 20 aa, Brucella spp.
REMPVRAVFHHARAPIQLYW

SEQ ID NO: 20922 - protein, 20 aa, Brucella spp.
AERKLIPALYQRQRAGQLSD

SEQ ID NO: 20923 - protein, 19 aa, Brucella spp.
VEIFLKRLHYVAVDAKSDE

SEQ ID NO: 20924 - protein, 19 aa, Brucella spp.
KKPEKIRAFYLAVSPTLFG

SEQ ID NO: 20925 - protein, 20 aa, Brucella spp.
KIRAFYLAVSPTLFGDIATR

SEQ ID NO: 20926 - protein, 27 aa, Brucella spp.
KAEIANWRWAGVPFYLRTGKRLATRVS

SEQ ID NO: 20927 - protein, 19 aa, Brucella spp.
ATRVSEIVITFKPIPHSIF

SEQ ID NO: 20928 - protein, 20 aa, Brucella spp.
SEIVITFKPIPHSIFGESAG

SEQ ID NO: 20929 - protein, 23 aa, Brucella spp.
LQPDEGVKQWLMIKDPGPGGMRL

SEQ ID NO: 20930 - protein, 26 aa, Brucella spp.
MRLRHMPLDMSFAESFEDRNPDAYER

SEQ ID NO: 20931 - protein, 30 aa, Brucella spp.
MRRDEVEAAWRWIDPILQAWEFNSQPVQGY

SEQ ID NO: 20932 - protein, 17 aa, Brucella spp.
ILQAWEFNSQPVQGYTA

SEQ ID NO: 20933 - protein, 19 aa, Brucella spp.
AAPGCVLISVIAPDFVSDK

SEQ ID NO: 20934 - protein, 17 aa, Brucella spp.
FSMLPTVLIGMGAASIC

SEQ ID NO: 20935 - protein, 24 aa, Brucella spp.
YYMGVAIPFYLAWVMSATLGAVFG

SEQ ID NO: 20936 - protein, 25 aa, Brucella spp.
PYGFDMAIPAVFLVLIAGMWKGFAA

SEQ ID NO: 20937 - protein, 22 aa, Brucella spp.
VAEEAKSYLLAFAEEHAIDMEY

SEQ ID NO: 20938 - protein, 22 aa, Brucella spp.
SASHVMPIRSFIGATAPLGDDS

SEQ ID NO: 20939 - protein, 27 aa, Brucella spp.
PALENVEITHAWGGSVGITMPRQPFVR

SEQ ID NO: 20940 - protein, 27 aa, Brucella spp.
QVREIAEPLGIRFLGVGGSPKWTLAET

SEQ ID NO: 20941 - protein, 19 aa, Brucella spp.
GKPNGLLSWRSSIWRDTDN

SEQ ID NO: 20942 - protein, 25 aa, Brucella spp.
RSGVLPFVFSENFGFADYVNWALDV

SEQ ID NO: 20943 - protein, 24 aa, Brucella spp.
VNWALDVPMYFILRDGHYHDCTHV

SEQ ID NO: 20944 - protein, 24 aa, Brucella spp.
STLFPEVRLKRFLEMRGADGGPWR

SEQ ID NO: 20945 - protein, 29 aa, Brucella spp.
DGGPWRRICALPAYWVGLLYDEEALAAAE

SEQ ID NO: 20946 - protein, 17 aa, Brucella spp.
LKISRLGLLNRKKLNSD

SEQ ID NO: 20947 - protein, 24 aa, Brucella spp.
QPKPSELIYCFAPLKQGRLDYMVQ

SEQ ID NO: 20948 - protein, 18 aa, Brucella spp.
CREALRFDRFLDQWDTSR

SEQ ID NO: 20949 - protein, 28 aa, Brucella spp.
EERQLLHRLPFVTAIPLGPRILRADTAA

SEQ ID NO: 20950 - protein, 18 aa, Brucella spp.
GRVFLTLVMVVMAGLLGW

SEQ ID NO: 20951 - protein, 34 aa, Brucella spp.
LVMVVMAGLLGWHLWDYYMNAPWTRDGKIRADVV

SEQ ID NO: 20952 - protein, 24 aa, Brucella spp.
SLLANVSPTFNWVRLAQRVPVRVK

SEQ ID NO: 20953 - protein, 21 aa, Brucella spp.
EDVPQGIHLVAGRTVSVSVVD

SEQ ID NO: 20954 - protein, 22 aa, Brucella spp.
FLAAFYSFAFLVTGFSGSSLAG

SEQ ID NO: 20955 - protein, 22 aa, Brucella spp.
AGETRYPLTLKNCGREVTFHHA

SEQ ID NO: 20956 - protein, 17 aa, Brucella spp.
SSAEILYNLGLGDRVVG

SEQ ID NO: 20957 - protein, 19 aa, Brucella spp.
AEILYNLGLGDRVVGTAVW

SEQ ID NO: 20958 - protein, 20 aa, Brucella spp.
RVVGTAVWFGPVMKGYEEVN

SEQ ID NO: 20959 - protein, 19 aa, Brucella spp.
GRLSAVVWFSSAQIDIDPY

SEQ ID NO: 20960 - protein, 21 aa, Brucella spp.
SEEEWPTVGWETIAKSDPTMI

SEQ ID NO: 20961 - protein, 24 aa, Brucella spp.
PHIKTHKLPFFARMQVKAGAVGIT

SEQ ID NO: 20962 - protein, 22 aa, Brucella spp.
SAGLCFGGLMTYPATGRGDEAE

SEQ ID NO: 20963 - protein, 17 aa, Brucella spp.
GTPDMWRIPAETVVTEY

SEQ ID NO: 20964 - protein, 23 aa, Brucella spp.
TEYRPGTYIYFDRYQVAEGAATI

SEQ ID NO: 20965 - protein, 20 aa, Brucella spp.
IPDHVCVVSNLFDEVHLVSG

SEQ ID NO: 20966 - protein, 19 aa, Brucella spp.
AGALALIFGATSIVPTVAA

SEQ ID NO: 20967 - protein, 21 aa, Brucella spp.
NDGWWYPLAAFGAGAIIGGAI

SEQ ID NO: 20968 - protein, 34 aa, Brucella spp.
EKAGARFGGFAGWNMPTTYPLGVMKEHLHTRDHA

SEQ ID NO: 20969 - protein, 23 aa, Brucella spp.
HTRDHAGLFDISHMKLVEVSGAD

SEQ ID NO: 20970 - protein, 20 aa, Brucella spp.
LPGADLAFMSGFEPKQSWFM

SEQ ID NO: 20971 - protein, 19 aa, Brucella spp.
FEPKQSWFMTRSGYTGEDG

SEQ ID NO: 20972 - protein, 17 aa, Brucella spp.
YTGEDGFEIGLPADEAR

SEQ ID NO: 20973 - protein, 19 aa, Brucella spp.
DGFEIGLPADEARALAEKL

SEQ ID NO: 20974 - protein, 23 aa, Brucella spp.
LLADERVEWIGLAARDSLRLEAG

SEQ ID NO: 20975 - protein, 23 aa, Brucella spp.
ETDPVSAGLTWAITKAVREKAAF

SEQ ID NO: 20976 - protein, 18 aa, Brucella spp.
PSAGFPVAMGYVEASLAT

SEQ ID NO: 20977 - protein, 17 aa, Brucella spp.
FVELPEVGRTVAKGDGV

SEQ ID NO: 20978 - protein, 22 aa, Brucella spp.
EGEGWLFKLKLADEGQLTGLLD

SEQ ID NO: 20979 - protein, 18 aa, Brucella spp.
SSQEGVALMCLAEALLRI

SEQ ID NO: 20980 - protein, 20 aa, Brucella spp.
EGVALMCLAEALLRIPDMAT

SEQ ID NO: 20981 - protein, 18 aa, Brucella spp.
LRIPDMATRDALIRDKIS

SEQ ID NO: 20982 - protein, 24 aa, Brucella spp.
DWKSHIGGGRSLFVNAATWGLVVT

SEQ ID NO: 20983 - protein, 18 aa, Brucella spp.
VIRRGVDMAMRMMGEQFV

SEQ ID NO: 20984 - protein, 19 aa, Brucella spp.
EERGFRYSYDMLGEAATTA

SEQ ID NO: 20985 - protein, 17 aa, Brucella spp.
RLELSLDLLQSLCEDPD

SEQ ID NO: 20986 - protein, 24 aa, Brucella spp.
EDPDLAGWDGIGFVVQAYGKRCPL

SEQ ID NO: 20987 - protein, 28 aa, Brucella spp.
VQAYGKRCPLVLDFIIDLARRTKRRVMV

SEQ ID NO: 20988 - protein, 18 aa, Brucella spp.
RLVKGAYWDAEIKRAQVD

SEQ ID NO: 20989 - protein, 17 aa, Brucella spp.
LEDFPVYTRKVHTDVSY

SEQ ID NO: 20990 - protein, 18 aa, Brucella spp.
ARKLLAATDVIFPQFATH

SEQ ID NO: 20991 - protein, 18 aa, Brucella spp.
TGKFEFQCLHGMGEPLYD

SEQ ID NO: 20992 - protein, 23 aa, Brucella spp.
GTHETLLAYLVRRLLENGANSSF

SEQ ID NO: 20993 - protein, 20 aa, Brucella spp.
DPVEVVRSMAVVGARHDQIA

SEQ ID NO: 20994 - protein, 25 aa, Brucella spp.
IMQRDMPALLGLVMREAGKSMPNAI

SEQ ID NO: 20995 - protein, 23 aa, Brucella spp.
AIAEVREAIDFLRYYAEQTRRTL

SEQ ID NO: 20996 - protein, 29 aa, Brucella spp.
HKALGPVVCISPWNFPLAIFTGQIAAALV

SEQ ID NO: 20997 - protein, 17 aa, Brucella spp.
AEQVVFDVIASAFDSAG

SEQ ID NO: 20998 - protein, 20 aa, Brucella spp.
KREVFGPVLHVVRYKRDDME

SEQ ID NO: 20999 - protein, 20 aa, Brucella spp.
AALKDFARWLGNRGMNDLAQ

SEQ ID NO: 21000 - protein, 22 aa, Brucella spp.
VPQTEIGLYRQLTAVLATGNTA

SEQ ID NO: 21001 - protein, 25 aa, Brucella spp.
LKDLPETVAARAIWTGDWQADAPFA

SEQ ID NO: 21002 - protein, 22 aa, Brucella spp.
PESAGWGYVGFGLYRLKAGESA

SEQ ID NO: 21003 - protein, 26 aa, Brucella spp.
TYYHRLNPAQGFGFQRVFTEDGSLDE

SEQ ID NO: 21004 - protein, 19 aa, Brucella spp.
YLNVMAGPLRKWRFKNHPD

SEQ ID NO: 21005 - protein, 22 aa, Brucella spp.
PEGDTFIAGVWAIFGHGNVAGL

SEQ ID NO: 21006 - protein, 22 aa, Brucella spp.
AHVNRLPVLFVPGDVFANRGPD

SEQ ID NO: 21007 - protein, 21 aa, Brucella spp.
RPEQLLTALPRAFRTMTDPAD

SEQ ID NO: 21008 - protein, 25 aa, Brucella spp.
AYDWPEEFFTPKVWHWRRPPPDERE

SEQ ID NO: 21009 - protein, 25 aa, Brucella spp.
GKSALPWDHPLNFGPVGVTGADSAN

SEQ ID NO: 21010 - protein, 20 aa, Brucella spp.
AEADLVIGVGTRFQDFTTGS

SEQ ID NO: 21011 - protein, 17 aa, Brucella spp.
FRHPGRRLLSLNVQPYD

SEQ ID NO: 21012 - protein, 18 aa, Brucella spp.
SLKNRWFAAADRFTAAPS

SEQ ID NO: 21013 - protein, 25 aa, Brucella spp.
AGTMPGELHQLWKAGRPMSYHMEYG

SEQ ID NO: 21014 - protein, 24 aa, Brucella spp.
SCMGYEIAGGLGIKMAEPDRDVIV

SEQ ID NO: 21015 - protein, 17 aa, Brucella spp.
ETGGWWWDVAVPEVSER

SEQ ID NO: 21016 - protein, 23 aa, Brucella spp.
DPERLTALVILGIRDQQHFPLIF

SEQ ID NO: 21017 - protein, 23 aa, Brucella spp.
HPRTEAAVLKALRLARENGSRTA

SEQ ID NO: 21018 - protein, 24 aa, Brucella spp.
GQGFPIEVFNVLGAGDGFMSGLLR

SEQ ID NO: 21019 - protein, 18 aa, Brucella spp.
WPTSLKFANACGAFAVSR

SEQ ID NO: 21020 - protein, 17 aa, Brucella spp.
PAYPSWEELQFFLQRGI

SEQ ID NO: 21021 - protein, 20 aa, Brucella spp.
PSWEELQFFLQRGIRNKALR

SEQ ID NO: 21022 - protein, 25 aa, Brucella spp.
RNGTWPHMRVFAFDHRIQLEEMAAE

SEQ ID NO: 21023 - protein, 18 aa, Brucella spp.
FKQLCLDAALKVAGGAQG

SEQ ID NO: 21024 - protein, 24 aa, Brucella spp.
GRPAEWPGSRPLKLEPELGPDCGG

SEQ ID NO: 21025 - protein, 25 aa, Brucella spp.
GGLMEWPVEHVVKLLCFYHPDDPAE

SEQ ID NO: 21026 - protein, 26 aa, Brucella spp.
IERFYEIGVYPDWWKLEPLKTKAAWA

SEQ ID NO: 21027 - protein, 18 aa, Brucella spp.
WKLEPLKTKAAWANACDA

SEQ ID NO: 21028 - protein, 18 aa, Brucella spp.
QSLGIAAGFDLVKGFAVG

SEQ ID NO: 21029 - protein, 20 aa, Brucella spp.
SAFMRFCQILGFSGFSEMQR

SEQ ID NO: 21030 - protein, 19 aa, Brucella spp.
FCQILGFSGFSEMQRLFRE

SEQ ID NO: 21031 - protein, 24 aa, Brucella spp.
GIRRAFPVASYLAYALEKMAVPAM

SEQ ID NO: 21032 - protein, 22 aa, Brucella spp.
IRKGDVLLAITFSPYSPETIGM

SEQ ID NO: 21033 - protein, 21 aa, Brucella spp.
LSATLCLAIAIAVAVGTARQA

SEQ ID NO: 21034 - protein, 17 aa, Brucella spp.
PLEAFFVPVSAATAALA

SEQ ID NO: 21035 - protein, 17 aa, Brucella spp.
TADLPPLLRAAIMHDAW

SEQ ID NO: 21036 - protein, 25 aa, Brucella spp.
PPLLRAAIMHDAWFSLEVVQRSAWV

SEQ ID NO: 21037 - protein, 17 aa, Brucella spp.
WVGRLLTATFLRQSGLA

SEQ ID NO: 21038 - protein, 23 aa, Brucella spp.
NSRLPQLMELILRTPLVSSQLVE

SEQ ID NO: 21039 - protein, 27 aa, Brucella spp.
TEQSFPGKWKVIFFYPKDFTFVCPTEI

SEQ ID NO: 21040 - protein, 17 aa, Brucella spp.
VCPTEIAEFARLASEFE

SEQ ID NO: 21041 - protein, 23 aa, Brucella spp.
DHKDLNKLPIWSFADTNGSLVDG

SEQ ID NO: 21042 - protein, 24 aa, Brucella spp.
ASAACVAALRPLGAFAQDAHQHMR

SEQ ID NO: 21043 - protein, 17 aa, Brucella spp.
GPHNVIAPGAKWEPKVA

SEQ ID NO: 21044 - protein, 19 aa, Brucella spp.
VAVNQPASFNWFHPHLHGH

SEQ ID NO: 21045 - protein, 17 aa, Brucella spp.
AHMGIAGLMIVRDGKDA

SEQ ID NO: 21046 - protein, 23 aa, Brucella spp.
DLIHGFRGDWLIVNGAIAPEARV

SEQ ID NO: 21047 - protein, 17 aa, Brucella spp.
LHLMRFTVDPALEGRVA

SEQ ID NO: 21048 - protein, 25 aa, Brucella spp.
SREMAHPFHIHGASFRILSMNGKKP

SEQ ID NO: 21049 - protein, 24 aa, Brucella spp.
FDREAARSHPFMFHCHLLEHEDVG

SEQ ID NO: 21050 - protein, 20 aa, Brucella spp.
TMVLMAFPAFAESTTVKMYE

SEQ ID NO: 21051 - protein, 21 aa, Brucella spp.
EAPGGLHFKVNMEKLTPGYHG

SEQ ID NO: 21052 - protein, 19 aa, Brucella spp.
GKIVPALAAGGHYDPGNTH

SEQ ID NO: 21053 - protein, 23 aa, Brucella spp.
DTFNWPQALGWLLVAGGVCATVW

SEQ ID NO: 21054 - protein, 25 aa, Brucella spp.
ARVAEKAGLAAYYIPAVGGQLTQEN

SEQ ID NO: 21055 - protein, 20 aa, Brucella spp.
IVPEEAPIAMSYNGTTQAVM

SEQ ID NO: 21056 - protein, 24 aa, Brucella spp.
PGDLEDFAIGFSLTENIVTRIEEI

SEQ ID NO: 21057 - protein, 22 aa, Brucella spp.
HGAGFFRPGEGLFAVREDIGRH

SEQ ID NO: 21058 - protein, 17 aa, Brucella spp.
GEGLFAVREDIGRHNAL

SEQ ID NO: 21059 - protein, 21 aa, Brucella spp.
TSFKIAFIQARWHADIVDEAR

SEQ ID NO: 21060 - protein, 21 aa, Brucella spp.
EIFDVPGAYEIPLHAKTLART

SEQ ID NO: 21061 - protein, 24 aa, Brucella spp.
TPRNELVSAMAWLTIPAMVGPLVG

SEQ ID NO: 21062 - protein, 25 aa, Brucella spp.
ERIIKRLDWPGFFLSGFAMSGVVFG

SEQ ID NO: 21063 - protein, 19 aa, Brucella spp.
GIGAIPFLLPLMFQLGFGL

SEQ ID NO: 21064 - protein, 24 aa, Brucella spp.
IPFLLPLMFQLGFGLTPFQSGMMT

SEQ ID NO: 21065 - protein, 17 aa, Brucella spp.
WIIIGFLLVGGFARSLF

SEQ ID NO: 21066 - protein, 27 aa, Brucella spp.
FFVVACVSVLAFFWFARLAPDAGKELA

SEQ ID NO: 21067 - protein, 24 aa, Brucella spp.
NLLEIPTSGTLLLGGQSITFEPNR

SEQ ID NO: 21068 - protein, 19 aa, Brucella spp.
RQTGMVFQNFQLFPHQTAI

SEQ ID NO: 21069 - protein, 17 aa, Brucella spp.
VMEGLVTVLKWPKNKAR

SEQ ID NO: 21070 - protein, 20 aa, Brucella spp.
EGLVTVLKWPKNKARERAME

SEQ ID NO: 21071 - protein, 21 aa, Brucella spp.
DVTLPKHLRPVASIGPIVSSA

SEQ ID NO: 21072 - protein, 22 aa, Brucella spp.
EVEYGLILASHAFSRWMVRCMA

SEQ ID NO: 21073 - protein, 17 aa, Brucella spp.
FSRWMVRCMAAAGLPGL

SEQ ID NO: 21074 - protein, 24 aa, Brucella spp.
GLSPIEILILHSIRHRDREKKLAD

SEQ ID NO: 21075 - protein, 24 aa, Brucella spp.
ETLSELAALLRFMSGAFNQATRSA

SEQ ID NO: 21076 - protein, 18 aa, Brucella spp.
IMLVGIVCGVFFRSISNL

SEQ ID NO: 21077 - protein, 18 aa, Brucella spp.
RIVLPVAVLLAVLCIVGG

SEQ ID NO: 21078 - protein, 18 aa, Brucella spp.
LISRIPRTLAIILAGMSM

SEQ ID NO: 21079 - protein, 19 aa, Brucella spp.
SASLGILLVILFAPETPVF

SEQ ID NO: 21080 - protein, 18 aa, Brucella spp.
LRSIPLRSVLVVPLVGIM

SEQ ID NO: 21081 - protein, 18 aa, Brucella spp.
FIAYRFDLLQSLNSWTTG

SEQ ID NO: 21082 - protein, 19 aa, Brucella spp.
RYELLWIAFALTVVAYVAA

SEQ ID NO: 21083 - protein, 23 aa, Brucella spp.
RLIRFPYEIPIGTMMGVVGSAIF

SEQ ID NO: 21084 - protein, 17 aa, Brucella spp.
PKERIAYIRRIAEIYES

SEQ ID NO: 21085 - protein, 25 aa, Brucella spp.
TISMEMGAPIKLARESQAAAGLSHT

SEQ ID NO: 21086 - protein, 27 aa, Brucella spp.
HEPIGVCGLITPWNWPMNQITLKVIPA

SEQ ID NO: 21087 - protein, 18 aa, Brucella spp.
IPAIAVGCTVVLKPSEIA

SEQ ID NO: 21088 - protein, 28 aa, Brucella spp.
KPSEIAPMSAMLFAEFVDQAGLPKGVFN

SEQ ID NO: 21089 - protein, 19 aa, Brucella spp.
FVDQAGLPKGVFNLVNGEG

SEQ ID NO: 21090 - protein, 20 aa, Brucella spp.
LEKAISRSLAHCFENTGQSC

SEQ ID NO: 21091 - protein, 23 aa, Brucella spp.
IAREEIFGPVLAMIPFDTEEEAI

SEQ ID NO: 21092 - protein, 27 aa, Brucella spp.
NEDERIELLALMWVGRGDFSATEWEEA

SEQ ID NO: 21093 - protein, 21 aa, Brucella spp.
EAKYLIGTPLLGDYIEEGLVA

SEQ ID NO: 21094 - protein, 25 aa, Brucella spp.
GGQAFWSLGGLFMIDSPEQRRLGVK

SEQ ID NO: 21095 - protein, 20 aa, Brucella spp.
WPKQWAEAYLQFAAGEMRPW

SEQ ID NO: 21096 - protein, 19 aa, Brucella spp.
AYLQFAAGEMRPWLLSLGM

SEQ ID NO: 21097 - protein, 32 aa, Brucella spp.
AAGEMRPWLLSLGMRWFPVVGWAERGGSHAHG

SEQ ID NO: 21098 - protein, 21 aa, Brucella spp.
EVIGDFEFSAGNIIVTSGGIG

SEQ ID NO: 21099 - protein, 23 aa, Brucella spp.
WPNHGIRILPGPSSMWFDAQGNR

SEQ ID NO: 21100 - protein, 24 aa, Brucella spp.
NRLPAPCLPGFDTLATLKHILSTG

SEQ ID NO: 21101 - protein, 21 aa, Brucella spp.
HILSTGYGYSWFILTEKIIRK

SEQ ID NO: 21102 - protein, 17 aa, Brucella spp.
YGYSWFILTEKIIRKEF

SEQ ID NO: 21103 - protein, 17 aa, Brucella spp.
VHTLKRFYEMPEKERPD

SEQ ID NO: 21104 - protein, 27 aa, Brucella spp.
SMCLSAITWSGFDNFYYLFSHEDSRDA

SEQ ID NO: 21105 - protein, 20 aa, Brucella spp.
FDGHNDVLLRLWSSNQPEPE

SEQ ID NO: 21106 - protein, 17 aa, Brucella spp.
FDADLDALYVLHAAGLR

SEQ ID NO: 21107 - protein, 21 aa, Brucella spp.
ADLDALYVLHAAGLRSLGPVW

SEQ ID NO: 21108 - protein, 18 aa, Brucella spp.
AAGLRSLGPVWSRPNIFA

SEQ ID NO: 21109 - protein, 26 aa, Brucella spp.
SRPNIFAHGIPFRFPSSPDIGPGLTD

SEQ ID NO: 21110 - protein, 25 aa, Brucella spp.
IRACNELKVMIDLSHMNEKGFWDIA

SEQ ID NO: 21111 - protein, 20 aa, Brucella spp.
TGGLVGLNFGVSFLREDGKH

SEQ ID NO: 21112 - protein, 18 aa, Brucella spp.
ASLVKLAHGNWIDVLERT

SEQ ID NO: 21113 - protein, 24 aa, Brucella spp.
IPMKGCEAILEWMIDQGAGREPAD

SEQ ID NO: 21114 - protein, 23 aa, Brucella spp.
IDVSGRIVVPGFIDTHLHIASSQ

SEQ ID NO: 21115 - protein, 25 aa, Brucella spp.
IANVLGAEGIRFFLDSALETVMDIR

SEQ ID NO: 21116 - protein, 24 aa, Brucella spp.
GAELLIDDLLPFADHPKVIGLAEF

SEQ ID NO: 21117 - protein, 29 aa, Brucella spp.
PFADHPKVIGLAEFMNFPGVLAKDPECMA

SEQ ID NO: 21118 - protein, 19 aa, Brucella spp.
ECMAKLRAFQGRHIDGHAP

SEQ ID NO: 21119 - protein, 22 aa, Brucella spp.
GHAPLLRGLDLNGYIAAGIRTE

SEQ ID NO: 21120 - protein, 17 aa, Brucella spp.
LDLNGYIAAGIRTEHEA

SEQ ID NO: 21121 - protein, 18 aa, Brucella spp.
LKALMPIITERHAQFLAL

SEQ ID NO: 21122 - protein, 18 aa, Brucella spp.
YRAASVSAARVFGLFDRG

SEQ ID NO: 21123 - protein, 17 aa, Brucella spp.
ASVSAARVFGLFDRGLV

SEQ ID NO: 21124 - protein, 22 aa, Brucella spp.
VLAEIPLPIAGLMSTEPYETVR

SEQ ID NO: 21125 - protein, 25 aa, Brucella spp.
SVLEEPFLQLAFIALPVIPHLKITD

SEQ ID NO: 21126 - protein, 23 aa, Brucella spp.
GALGFLPILGFWMLPLGLIVLSH

SEQ ID NO: 21127 - protein, 23 aa, Brucella spp.
NRDAICFPIRVLQIANDTGAERP

SEQ ID NO: 21128 - protein, 17 aa, Brucella spp.
AERPWTFSELARLVGGI

SEQ ID NO: 21129 - protein, 20 aa, Brucella spp.
PWTFSELARLVGGIKEPYND

SEQ ID NO: 21130 - protein, 20 aa, Brucella spp.
AGHVRFFYARLGYLAKRQAA

SEQ ID NO: 21131 - protein, 26 aa, Brucella spp.
TNIEELLIGIPLEWRADWEPTAEAIA

SEQ ID NO: 21132 - protein, 18 aa, Brucella spp.
VLLDVLMPGLDGFEVCRR

SEQ ID NO: 21133 - protein, 17 aa, Brucella spp.
TANIPVIMITCLTSPED

SEQ ID NO: 21134 - protein, 17 aa, Brucella spp.
SRLKSLTRLKMMSDELF

SEQ ID NO: 21135 - protein, 24 aa, Brucella spp.
QRTRLIPIILMVWEDEGALVVRAL

SEQ ID NO: 21136 - protein, 17 aa, Brucella spp.
RALELGVNDYLMRPLEK

SEQ ID NO: 21137 - protein, 22 aa, Brucella spp.
YIDMHMPLLLTRAIERKQPLSI

SEQ ID NO: 21138 - protein, 17 aa, Brucella spp.
IERKQPLSIIMIDLDHF

SEQ ID NO: 21139 - protein, 22 aa, Brucella spp.
RADDLPAYLTILVVGHIVVGLF

SEQ ID NO: 21140 - protein, 23 aa, Brucella spp.
AGKRELAKAFNIKGDARVYLKDL

SEQ ID NO: 21141 - protein, 21 aa, Brucella spp.
EHEIPHVFPDEVLREAETAGP

SEQ ID NO: 21142 - protein, 24 aa, Brucella spp.
SVYFPDRVVPMLPKRISNDLCSLR

SEQ ID NO: 21143 - protein, 25 aa, Brucella spp.
EMEDRPALAVRMIFSADGRKKSHKF

SEQ ID NO: 21144 - protein, 24 aa, Brucella spp.
GPILDTVLKPLWNAYAVLKRGRDA

SEQ ID NO: 21145 - protein, 19 aa, Brucella spp.
RLDAHKLIEEFMIQANVSA

SEQ ID NO: 21146 - protein, 23 aa, Brucella spp.
TLEGRHQPLIFRIHGEPALAKQE

SEQ ID NO: 21147 - protein, 19 aa, Brucella spp.
PDNIGHFGLHLRRYAHFTS

SEQ ID NO: 21148 - protein, 21 aa, Brucella spp.
LIVHRALIKALGLGTDGLTSA

SEQ ID NO: 21149 - protein, 24 aa, Brucella spp.
RVTGVTRAGLFVNLATYGADGLVP

SEQ ID NO: 21150 - protein, 25 aa, Brucella spp.
RLVEALPVAGAVRFEMVSEPHPLPM

SEQ ID NO: 21151 - protein, 23 aa, Brucella spp.
LGSDYKVLASFGHVRDLPAKDGS

SEQ ID NO: 21152 - protein, 21 aa, Brucella spp.
VRPDEDFAMSWEVDSNSAKRL

SEQ ID NO: 21153 - protein, 25 aa, Brucella spp.
DREGEAISWHVLEVLRQKKALNGKT

SEQ ID NO: 21154 - protein, 31 aa, Brucella spp.
YLARRALDYLVGFTLSPVLWRKLPGARSAGR

SEQ ID NO: 21155 - protein, 18 aa, Brucella spp.
IERFVREEYWNIAALLKT

SEQ ID NO: 21156 - protein, 23 aa, Brucella spp.
FVREEYWNIAALLKTPRNDSFTA

SEQ ID NO: 21157 - protein, 17 aa, Brucella spp.
MLESANFKAVSVEAKPT

SEQ ID NO: 21158 - protein, 27 aa, Brucella spp.
EDQARLYELIWKRAIASQMQAADIERT

SEQ ID NO: 21159 - protein, 19 aa, Brucella spp.
AKLPEIRSGEALAREKIDA

SEQ ID NO: 21160 - protein, 18 aa, Brucella spp.
MEELGIGRPSTYAATLAT

SEQ ID NO: 21161 - protein, 17 aa, Brucella spp.
LGIGRPSTYAATLATLR

SEQ ID NO: 21162 - protein, 22 aa, Brucella spp.
KGRLVTAFLESFFERYVEYDFT

SEQ ID NO: 21163 - protein, 33 aa, Brucella spp.
KLDLISDGKLSWKEILRDFWRAFSGSVEDIKEL

SEQ ID NO: 21164 - protein, 22 aa, Brucella spp.
DIKELRVTNVLDALNEELAPLV

SEQ ID NO: 21165 - protein, 23 aa, Brucella spp.
ALNEELAPLVFPAREDGSDPRSC

SEQ ID NO: 21166 - protein, 19 aa, Brucella spp.
CPTCGTGTLSLKLGRYGAF

SEQ ID NO: 21167 - protein, 25 aa, Brucella spp.
GTGTLSLKLGRYGAFVGCSNYPECK

SEQ ID NO: 21168 - protein, 19 aa, Brucella spp.
NYPECKYTRQLGGEANGET

SEQ ID NO: 21169 - protein, 23 aa, Brucella spp.
NVEEVFSVGLNRAVSVLADKQSK

SEQ ID NO: 21170 - protein, 24 aa, Brucella spp.
KQAQNPMLVYLLEMAQEEARDSIE

SEQ ID NO: 21171 - protein, 19 aa, Brucella spp.
SDRQRLNWLRLIRTDNIGA

SEQ ID NO: 21172 - protein, 19 aa, Brucella spp.
LEMLPDLNIRGGSARPIRI

SEQ ID NO: 21173 - protein, 17 aa, Brucella spp.
IERMGARLIGMGEPEYP

SEQ ID NO: 21174 - protein, 20 aa, Brucella spp.
YPPENLPLYRAIPENGGALI

SEQ ID NO: 21175 - protein, 18 aa, Brucella spp.
RRNRIIAGLSLGLIVVEA

SEQ ID NO: 21176 - protein, 21 aa, Brucella spp.
ILLELDLAGRLLRYPGNRVAI

SEQ ID NO: 21177 - protein, 23 aa, Brucella spp.
LFPHRHLLGIKGLSPLDILCLLD

SEQ ID NO: 21178 - protein, 23 aa, Brucella spp.
GLSPLDILCLLDLADQEIAVSRQ

SEQ ID NO: 21179 - protein, 19 aa, Brucella spp.
KDADVVMMLRLQRERMAGS

SEQ ID NO: 21180 - protein, 31 aa, Brucella spp.
RERMAGSFVPSVREYFHFYGLDREKLKFAKP

SEQ ID NO: 21181 - protein, 20 aa, Brucella spp.
KFAKPDALVMHPGPMNRGVE

SEQ ID NO: 21182 - protein, 19 aa, Brucella spp.
MGVAVRMAVMEALLDPRRN

SEQ ID NO: 21183 - protein, 21 aa, Brucella spp.
LGDPLLMQIAARFPKELHTEL

SEQ ID NO: 21184 - protein, 19 aa, Brucella spp.
AQLEAGHLCPLTMTSASLA

SEQ ID NO: 21185 - protein, 18 aa, Brucella spp.
AGHLCPLTMTSASLAALM

SEQ ID NO: 21186 - protein, 18 aa, Brucella spp.
FSQKPAFRKQGVTLGMGM

SEQ ID NO: 21187 - protein, 18 aa, Brucella spp.
FRKQGVTLGMGMTEKQGG

SEQ ID NO: 21188 - protein, 25 aa, Brucella spp.
TRAEPAIGGAWRLTGHKWFMSAPMS

SEQ ID NO: 21189 - protein, 19 aa, Brucella spp.
WRLTGHKWFMSAPMSDAFL

SEQ ID NO: 21190 - protein, 23 aa, Brucella spp.
TKEGLSCFLLPRLGEKGESNGFF

SEQ ID NO: 21191 - protein, 19 aa, Brucella spp.
GEKGESNGFFFQRLKDKLG

SEQ ID NO: 21192 - protein, 28 aa, Brucella spp.
LDVAGATALSMRLARAFDMAASDRAEAA

SEQ ID NO: 21193 - protein, 19 aa, Brucella spp.
AAFARSMTPVVKYWVCKIA

SEQ ID NO: 21194 - protein, 28 aa, Brucella spp.
MTPVVKYWVCKIAPALLYEAMECLGGNG

SEQ ID NO: 21195 - protein, 18 aa, Brucella spp.
RAPALFDGVLDWISGQLG

SEQ ID NO: 21196 - protein, 17 aa, Brucella spp.
ALFDGVLDWISGQLGPR

SEQ ID NO: 21197 - protein, 18 aa, Brucella spp.
GVARLLTEQLAFAAAAAE

SEQ ID NO: 21198 - protein, 20 aa, Brucella spp.
IETRLGGLWRTTYGMLDARH

SEQ ID NO: 21199 - protein, 22 aa, Brucella spp.
RVETAKAVILIDPFLNGNPGAK

SEQ ID NO: 21200 - protein, 25 aa, Brucella spp.
QPEIGIVPIGDRFTMGGAVAALACQ

SEQ ID NO: 21201 - protein, 17 aa, Brucella spp.
QRYFNFNSVLPCHYASF

SEQ ID NO: 21202 - protein, 23 aa, Brucella spp.
NSVLPCHYASFPIIDRTADKFIA

SEQ ID NO: 21203 - protein, 23 aa, Brucella spp.
RMTGELNAILGFVEQLNEVDVEG

SEQ ID NO: 21204 - protein, 19 aa, Brucella spp.
AKGEAGALEGIPLGVKDLF

SEQ ID NO: 21205 - protein, 19 aa, Brucella spp.
GALEGIPLGVKDLFATKGV

SEQ ID NO: 21206 - protein, 20 aa, Brucella spp.
IPLGVKDLFATKGVHTQACS

SEQ ID NO: 21207 - protein, 24 aa, Brucella spp.
KPEYESTVTANLWADGAVMLGKLN

SEQ ID NO: 21208 - protein, 17 aa, Brucella spp.
YGRVSRWGTVAFASSLD

SEQ ID NO: 21209 - protein, 23 aa, Brucella spp.
VPDYEAALGRSVKGMKIGIPREY

SEQ ID NO: 21210 - protein, 18 aa, Brucella spp.
VKGMKIGIPREYRVDGMP

SEQ ID NO: 21211 - protein, 21 aa, Brucella spp.
MKIGIPREYRVDGMPGEIEEL

SEQ ID NO: 21212 - protein, 23 aa, Brucella spp.
DGMPGEIEELWQKGIQYLKDAGA

SEQ ID NO: 21213 - protein, 22 aa, Brucella spp.
PHTKYALPAYYIVAPAEASSNL

SEQ ID NO: 21214 - protein, 18 aa, Brucella spp.
QTRAAGFGKEVKRRIMIG

SEQ ID NO: 21215 - protein, 23 aa, Brucella spp.
FGKEVKRRIMIGTYVLSAGYYDA

SEQ ID NO: 21216 - protein, 21 aa, Brucella spp.
GQGLPLGLQLIGRPFEEETLF

SEQ ID NO: 21217 - protein, 19 aa, Brucella spp.
PFEEETLFQAAHVIEQAAG

SEQ ID NO: 21218 - protein, 26 aa, Brucella spp.
VLEGLEPVRLRPGMYIGGTDEKALHH

SEQ ID NO: 21219 - protein, 17 aa, Brucella spp.
YRQCFSRGIPQGGLEEL

SEQ ID NO: 21220 - protein, 24 aa, Brucella spp.
YRMARSKAYLFGGVEIRWNCDPSL

SEQ ID NO: 21221 - protein, 18 aa, Brucella spp.
GGVEIRWNCDPSLLDPKK

SEQ ID NO: 21222 - protein, 24 aa, Brucella spp.
KETPEKAVFHFPGGLKDYLEASLG

SEQ ID NO: 21223 - protein, 25 aa, Brucella spp.
GGHGAVEWAVAWFGGDGFVHSYCNT

SEQ ID NO: 21224 - protein, 24 aa, Brucella spp.
HEAGLRIALTRGLKAYAELTNNKR

SEQ ID NO: 21225 - protein, 20 aa, Brucella spp.
VMVSAAGMLSVFIREPEFVG

SEQ ID NO: 21226 - protein, 17 aa, Brucella spp.
AIRDPFDHWLAASPQEA

SEQ ID NO: 21227 - protein, 24 aa, Brucella spp.
ASPQEASRLLEWVIDRADERLRRR

SEQ ID NO: 21228 - protein, 25 aa, Brucella spp.
DGAHIASLLITFFYQEMPELIRNGH

SEQ ID NO: 21229 - protein, 19 aa, Brucella spp.
QEMPELIRNGHLYLAVPPL

SEQ ID NO: 21230 - protein, 26 aa, Brucella spp.
ELIRNGHLYLAVPPLYRLSQGGKTAY

SEQ ID NO: 21231 - protein, 23 aa, Brucella spp.
RGKIEIGRFKGLGEMRADQLKET

SEQ ID NO: 21232 - protein, 25 aa, Brucella spp.
RFFVQCWLMFFIILVVGGLRALATS

SEQ ID NO: 21233 - protein, 18 aa, Brucella spp.
GALMGFGGLCFFTAVKYM

SEQ ID NO: 21234 - protein, 18 aa, Brucella spp.
FGGLCFFTAVKYMPLADA

SEQ ID NO: 21235 - protein, 18 aa, Brucella spp.
PLILTLFSALFLKEKVGW

SEQ ID NO: 21236 - protein, 17 aa, Brucella spp.
PSFEIFGMVSLLPLATA

SEQ ID NO: 21237 - protein, 17 aa, Brucella spp.
FEIFGMVSLLPLATAVT

SEQ ID NO: 21238 - protein, 20 aa, Brucella spp.
HSVQPWLLLLLLGTIGTVSH

SEQ ID NO: 21239 - protein, 21 aa, Brucella spp.
DAPPVEWLIAEGLTDYEEALA

SEQ ID NO: 21240 - protein, 22 aa, Brucella spp.
ASELVWLVEHPPLYTAGTSANA

SEQ ID NO: 21241 - protein, 17 aa, Brucella spp.
TPDRFPVFNTGRGGEYT

SEQ ID NO: 21242 - protein, 24 aa, Brucella spp.
LEQWIIETLAAFNIKGERREDRVG

SEQ ID NO: 21243 - protein, 23 aa, Brucella spp.
KIAAIGIRLRRWVSFHGIAINVE

SEQ ID NO: 21244 - protein, 21 aa, Brucella spp.
HLPDNPIVFANPAFLKLTGYE

SEQ ID NO: 21245 - protein, 24 aa, Brucella spp.
DYIVEVANIGFWTREFYSGKMTCS

SEQ ID NO: 21246 - protein, 20 aa, Brucella spp.
TCSAECRRIYGFTPDEPVHF

SEQ ID NO: 21247 - protein, 17 aa, Brucella spp.
RRIYGFTPDEPVHFDTI

SEQ ID NO: 21248 - protein, 23 aa, Brucella spp.
TPDEPVHFDTILDLVVLEDRMTV

SEQ ID NO: 21249 - protein, 17 aa, Brucella spp.
YSIEYRIVTRLGETRWL

SEQ ID NO: 21250 - protein, 17 aa, Brucella spp.
LTGENPLVLGIVQDVTE

SEQ ID NO: 21251 - protein, 20 aa, Brucella spp.
GENPLVLGIVQDVTERKKAE

SEQ ID NO: 21252 - protein, 18 aa, Brucella spp.
MLLKENWAGATIQQICAT

SEQ ID NO: 21253 - protein, 24 aa, Brucella spp.
VSDRVTVALSLAFYELATNAVKYG

SEQ ID NO: 21254 - protein, 23 aa, Brucella spp.
LKAKCDVEFAASGLLIDVLAPIT

SEQ ID NO: 21255 - protein, 18 aa, Brucella spp.
FAASGLLIDVLAPITPEV

SEQ ID NO: 21256 - protein, 21 aa, Brucella spp.
LHSGKIARFWAQLYNADEPVI

SEQ ID NO: 21257 - protein, 21 aa, Brucella spp.
MPKGDPVGLAILLSDEKGIGD

SEQ ID NO: 21258 - protein, 22 aa, Brucella spp.
IIVMPVELGPWRAALDKEDGEC

SEQ ID NO: 21259 - protein, 28 aa, Brucella spp.
IAKEALRGLDLGVYFHPVLTGIGQGATI

SEQ ID NO: 21260 - protein, 17 aa, Brucella spp.
PDFSARMKMAVDNVVAM

SEQ ID NO: 21261 - protein, 23 aa, Brucella spp.
GVHVIGVDSLRYFWSERTPEEIA

SEQ ID NO: 21262 - protein, 23 aa, Brucella spp.
FGADTFPFAWKYLDPSIQDRTRM

SEQ ID NO: 21263 - protein, 19 aa, Brucella spp.
YEPIAAALLDKMRSRAGLP

SEQ ID NO: 21264 - protein, 22 aa, Brucella spp.
RSLGFAALCFVLGFTTVFVALG

SEQ ID NO: 21265 - protein, 23 aa, Brucella spp.
LGLGIPFLIAALFSGAFMRFLSR

SEQ ID NO: 21266 - protein, 21 aa, Brucella spp.
VEKAMGVLLIIAGVVFLTGGM

SEQ ID NO: 21267 - protein, 17 aa, Brucella spp.
MLDPFFASVRSLSGIGP

SEQ ID NO: 21268 - protein, 25 aa, Brucella spp.
VPGGEPKIGQLLFLPPHSIIDRRNR

SEQ ID NO: 21269 - protein, 24 aa, Brucella spp.
DDTGEIALTFFHAQLPWLQKMLPE

SEQ ID NO: 21270 - protein, 18 aa, Brucella spp.
HAQLPWLQKMLPEGETVI

SEQ ID NO: 21271 - protein, 18 aa, Brucella spp.
GETVIVSGKVEWFNGRAS

SEQ ID NO: 21272 - protein, 32 aa, Brucella spp.
KEALTRVPVLPEWIDAPLLAREGFPAFQQALN

SEQ ID NO: 21273 - protein, 19 aa, Brucella spp.
LAREGFPAFQQALNTLHQP

SEQ ID NO: 21274 - protein, 20 aa, Brucella spp.
DEFLAGQLALALVRAKTRRL

SEQ ID NO: 21275 - protein, 21 aa, Brucella spp.
KSGEIDIVIGTHALFQEKVEY

SEQ ID NO: 21276 - protein, 23 aa, Brucella spp.
ATPIPRTLVLTAFGDMDVSKLTE

SEQ ID NO: 21277 - protein, 19 aa, Brucella spp.
SEDQKIYWICPLVEESEVV

SEQ ID NO: 21278 - protein, 19 aa, Brucella spp.
HAERFGLSQLHQLRGRVGR

SEQ ID NO: 21279 - protein, 22 aa, Brucella spp.
GDKPSTCLLLYKGPLGEIAQAR

SEQ ID NO: 21280 - protein, 26 aa, Brucella spp.
SERGQALRVLLYLFGRDEAIRLLRAG

SEQ ID NO: 21281 - protein, 23 aa, Brucella spp.
EEIGERGPIMYIVRDGQRIADLE

SEQ ID NO: 21282 - protein, 25 aa, Brucella spp.
VSPDLPVLHLPAWDCLPYDRVSPGA

SEQ ID NO: 21283 - protein, 21 aa, Brucella spp.
GAEEPLRLDFFGDTLETIRAF

SEQ ID NO: 21284 - protein, 26 aa, Brucella spp.
VFDHAGPMPVVFDHLVHEALTERHTM

SEQ ID NO: 21285 - protein, 19 aa, Brucella spp.
AEAAGLRIDLTPFGAPEVS

SEQ ID NO: 21286 - protein, 23 aa, Brucella spp.
HVDHGIGRFIGLKTITAAGAPHD

SEQ ID NO: 21287 - protein, 20 aa, Brucella spp.
PGGLYAEFAARFPYDETDDQ

SEQ ID NO: 21288 - protein, 19 aa, Brucella spp.
MDRLICGDVGFGKTEVALR

SEQ ID NO: 21289 - protein, 17 aa, Brucella spp.
TEVALRAAFIAAMSGVQ

SEQ ID NO: 21290 - protein, 19 aa, Brucella spp.
LGSSIKFKNLGLLIIDEEQ

SEQ ID NO: 21291 - protein, 18 aa, Brucella spp.
RTLQLALTGVRELSLITT

SEQ ID NO: 21292 - protein, 22 aa, Brucella spp.
ERYRGGQSFYVVPRIADLTDIE

SEQ ID NO: 21293 - protein, 18 aa, Brucella spp.
HVPELKVAVAHGQMAPGV

SEQ ID NO: 21294 - protein, 23 aa, Brucella spp.
RADMFGLAQLYQLRGRVGRSKQR

SEQ ID NO: 21295 - protein, 25 aa, Brucella spp.
EAYVPDLQLRLGLYRRLADLEEPQD

SEQ ID NO: 21296 - protein, 22 aa, Brucella spp.
IDAFGAELIDRFGPMPDEVQHL

SEQ ID NO: 21297 - protein, 26 aa, Brucella spp.
PMPDEVQHLLKIVYIKALCRRANVEK

SEQ ID NO: 21298 - protein, 20 aa, Brucella spp.
RPDQSIVFIRDWPTPEKRLN

SEQ ID NO: 21299 - protein, 20 aa, Brucella spp.
TFSLSKERFFLIGNGKEPIW

SEQ ID NO: 21300 - protein, 17 aa, Brucella spp.
AYLKRIRALGLEVREGR

SEQ ID NO: 21301 - protein, 20 aa, Brucella spp.
SRVPGEGQSIYFYDDDNHMF

SEQ ID NO: 21302 - protein, 26 aa, Brucella spp.
DVVSDVVCPWCFLGRKRLEAALASLP

SEQ ID NO: 21303 - protein, 20 aa, Brucella spp.
VEAEIRWRPFQLDPTLPPHG

SEQ ID NO: 21304 - protein, 24 aa, Brucella spp.
RALGEEYGIVFDFDAIIRAPNTLD

SEQ ID NO: 21305 - protein, 26 aa, Brucella spp.
DTQDRMVGMLFSLYFEQGQDIGNHEV

SEQ ID NO: 21306 - protein, 19 aa, Brucella spp.
TANRIGVRGVPCFIIDQKY

SEQ ID NO: 21307 - protein, 21 aa, Brucella spp.
IGVRGVPCFIIDQKYAVMGAQ

SEQ ID NO: 21308 - protein, 18 aa, Brucella spp.
YTAMWWWLGLALFVDGID

SEQ ID NO: 21309 - protein, 28 aa, Brucella spp.
KGFPVVWNMVVFTLFIVRPGEWVAFGTV

SEQ ID NO: 21310 - protein, 32 aa, Brucella spp.
RLRPLNLTIFLLWCAFGVIALYYMLDAPLWVR

SEQ ID NO: 21311 - protein, 17 aa, Brucella spp.
LDAPLWVRIGISVTGLY

SEQ ID NO: 21312 - protein, 33 aa, Brucella spp.
HAEEKLKVGFIYIGPPGDFGWTYQHDQARKELV

SEQ ID NO: 21313 - protein, 27 aa, Brucella spp.
SVNPDFRVKVIWVNSWFDPGKEADAAK

SEQ ID NO: 21314 - protein, 18 aa, Brucella spp.
SQNIWWGMKEGLVKMAPF

SEQ ID NO: 21315 - protein, 18 aa, Brucella spp.
GMKEGLVKMAPFTNMPDD

SEQ ID NO: 21316 - protein, 19 aa, Brucella spp.
HPNVLAITGPQAYESVMNA

SEQ ID NO: 21317 - protein, 26 aa, Brucella spp.
GCSNRCSFCIIPALRGDLVSRPINEV

SEQ ID NO: 21318 - protein, 28 aa, Brucella spp.
DLSRELGEMGVWVRMHYVYPYPHVDEVI

SEQ ID NO: 21319 - protein, 26 aa, Brucella spp.
IPLMAEGKILPYLDIPFQHASPAVLK

SEQ ID NO: 21320 - protein, 21 aa, Brucella spp.
TCPDLAVRSTFIVGYPGETEE

SEQ ID NO: 21321 - protein, 25 aa, Brucella spp.
GETEEDFQMLLDWLDEAKIERAGCF

SEQ ID NO: 21322 - protein, 27 aa, Brucella spp.
ALFLELGAVNQYWLHYRLLNDWGYTRL

SEQ ID NO: 21323 - protein, 25 aa, Brucella spp.
HHADKLINRIIFFEGFPNLQTVSPL

SEQ ID NO: 21324 - protein, 27 aa, Brucella spp.
ARAYNVSELFLFKILQPLVEHGLVETV

SEQ ID NO: 21325 - protein, 22 aa, Brucella spp.
REALNAFFAVLMKYSIADLVKA

SEQ ID NO: 21326 - protein, 17 aa, Brucella spp.
TSHPVGGVCPFGLPGAL

SEQ ID NO: 21327 - protein, 34 aa, Brucella spp.
HPVGGVCPFGLPGALPVFCDISLKTYDEVVPAAG

SEQ ID NO: 21328 - protein, 17 aa, Brucella spp.
ALEQLYGGRTWRWNDGG

SEQ ID NO: 21329 - protein, 18 aa, Brucella spp.
GGRTWRWNDGGGYFSTKK

SEQ ID NO: 21330 - protein, 17 aa, Brucella spp.
TARSFATGRWFATDGGK

SEQ ID NO: 21331 - protein, 20 aa, Brucella spp.
GKLCMKAYWSNAGGGSGAIT

SEQ ID NO: 21332 - protein, 19 aa, Brucella spp.
QKPNLGGQWYVFRHNPVQK

SEQ ID NO: 21333 - protein, 17 aa, Brucella spp.
EPWSWARDWRVGPEDLL

SEQ ID NO: 21334 - protein, 23 aa, Brucella spp.
EDDAGQFTWAFWKPEGYVKAYRH

SEQ ID NO: 21335 - protein, 22 aa, Brucella spp.
HAEFPAMTAVVYFNDREVYPWP

SEQ ID NO: 21336 - protein, 17 aa, Brucella spp.
GTCFAAWGHEVVCGDKN

SEQ ID NO: 21337 - protein, 18 aa, Brucella spp.
IAVLERGILPIYEPGLDE

SEQ ID NO: 21338 - protein, 20 aa, Brucella spp.
AGTFSVASNPEFLREGVAIR

SEQ ID NO: 21339 - protein, 30 aa, Brucella spp.
VASNPEFLREGVAIRDFLYPDRVVIGVEDE

SEQ ID NO: 21340 - protein, 18 aa, Brucella spp.
KRRMALKVLDALGGDVEG

SEQ ID NO: 21341 - protein, 19 aa, Brucella spp.
PLIETLQRFGARIRAYDPI

SEQ ID NO: 21342 - protein, 19 aa, Brucella spp.
MVVITEWDSIRRLDLSRVR

SEQ ID NO: 21343 - protein, 24 aa, Brucella spp.
NAYEPNVAENLGFRVSAVGRAATA

SEQ ID NO: 21344 - protein, 19 aa, Brucella spp.
TSIKDALSLLASRSRRADS

SEQ ID NO: 21345 - protein, 24 aa, Brucella spp.
QQYGVDIRIVRIFNTYGPRMRPDD

SEQ ID NO: 21346 - protein, 19 aa, Brucella spp.
IRVPVNIGNPGEFTVGALA

SEQ ID NO: 21347 - protein, 18 aa, Brucella spp.
GIVCGIMPTGERNAITDV

SEQ ID NO: 21348 - protein, 20 aa, Brucella spp.
RKVLAACDIINGFGKSTGLV

SEQ ID NO: 21349 - protein, 20 aa, Brucella spp.
SLETPILLTNTFGVGTCANA

SEQ ID NO: 21350 - protein, 23 aa, Brucella spp.
GTGMTCFGFKGGIGTSSRRFEFD

SEQ ID NO: 21351 - protein, 22 aa, Brucella spp.
GKLHHLGILALTNFGRAGDLVL

SEQ ID NO: 21352 - protein, 17 aa, Brucella spp.
GSVILVLATDVALEHRQ

SEQ ID NO: 21353 - protein, 25 aa, Brucella spp.
TRRCGAGLARLGAFWGHGSGDIAIG

SEQ ID NO: 21354 - protein, 22 aa, Brucella spp.
GSGDIAIGFTTGITFDHDEPND

SEQ ID NO: 21355 - protein, 17 aa, Brucella spp.
LTTFAAKSPLGITTQNP

SEQ ID NO: 21356 - protein, 18 aa, Brucella spp.
ARTLEWKDGIVHRLNSGV

SEQ ID NO: 21357 - protein, 18 aa, Brucella spp.
EIQALPFGGNIISSTEAL

SEQ ID NO: 21358 - protein, 25 aa, Brucella spp.
SLEKIPERLAVVGGGYIGLEIGTAF

SEQ ID NO: 21359 - protein, 24 aa, Brucella spp.
GYIGLEIGTAFAKLGSRVMVVEAT

SEQ ID NO: 21360 - protein, 18 aa, Brucella spp.
YDAELTRPVMARLKTLGV

SEQ ID NO: 21361 - protein, 18 aa, Brucella spp.
LTRPVMARLKTLGVEVLT

SEQ ID NO: 21362 - protein, 19 aa, Brucella spp.
IEVQFADYVYPAYDQIVSE

SEQ ID NO: 21363 - protein, 26 aa, Brucella spp.
RSAGEFTCPIVIRMPSGGGIYGGQTH

SEQ ID NO: 21364 - protein, 17 aa, Brucella spp.
GYYTVPLGKAAIRREGS

SEQ ID NO: 21365 - protein, 19 aa, Brucella spp.
DLRTLLPLDTETIMASVKK

SEQ ID NO: 21366 - protein, 22 aa, Brucella spp.
PYPHAQEWAYFPGPDRVGRALV

SEQ ID NO: 21367 - protein, 21 aa, Brucella spp.
AYHRNPGFEIVGLVNRTKVPV

SEQ ID NO: 21368 - protein, 22 aa, Brucella spp.
PVPDELAGYIIHPSFHEALKEL

SEQ ID NO: 21369 - protein, 31 aa, Brucella spp.
RANGRKLVIGYILRHHLSWMRLIEEARKLGG

SEQ ID NO: 21370 - protein, 26 aa, Brucella spp.
IEEARKLGGPYVFRMNLNQQSSGATW

SEQ ID NO: 21371 - protein, 17 aa, Brucella spp.
GWGPMMSETAFFVKDVI

SEQ ID NO: 21372 - protein, 18 aa, Brucella spp.
EREQAFMLKAIRENLDHD

SEQ ID NO: 21373 - protein, 19 aa, Brucella spp.
FPTPESFSLIGYETVLKQG

SEQ ID NO: 21374 - protein, 19 aa, Brucella spp.
GIMIPIRLGTVALLQGMVA

SEQ ID NO: 21375 - protein, 25 aa, Brucella spp.
DGMSEYAIFFKLVLPLIRPAMATVA

SEQ ID NO: 21376 - protein, 23 aa, Brucella spp.
IPIWNDLWFPLILAPSEATKTVT

SEQ ID NO: 21377 - protein, 23 aa, Brucella spp.
LAMFPILILYVLFSRQLIRGITA

SEQ ID NO: 21378 - protein, 17 aa, Brucella spp.
ALFLPTLLSFVIVGFIW

SEQ ID NO: 21379 - protein, 20 aa, Brucella spp.
PTLLSFVIVGFIWKLILSPI

SEQ ID NO: 21380 - protein, 25 aa, Brucella spp.
IVGFIWKLILSPIWGVAPWMMDLVG

SEQ ID NO: 21381 - protein, 19 aa, Brucella spp.
DLVGLKWAFAPWLGKADTA

SEQ ID NO: 21382 - protein, 18 aa, Brucella spp.
SQFFKIKLPLILPSIGLI

SEQ ID NO: 21383 - protein, 17 aa, Brucella spp.
GTFLYRTFFGFQLQLGN

SEQ ID NO: 21384 - protein, 17 aa, Brucella spp.
GTLLPFVARTDVERRVV

SEQ ID NO: 21385 - protein, 22 aa, Brucella spp.
PVWEGNQVWLILGGGAIFAAWP

SEQ ID NO: 21386 - protein, 18 aa, Brucella spp.
LAMFVILFALILRPVGFK

SEQ ID NO: 21387 - protein, 23 aa, Brucella spp.
RNSWDWALFIGGFVPALIFGVAV

SEQ ID NO: 21388 - protein, 20 aa, Brucella spp.
EGSFFGLLNPFALLCGILSV

SEQ ID NO: 21389 - protein, 24 aa, Brucella spp.
GIVMEFQFGMNWSYYSHYVGDIFG

SEQ ID NO: 21390 - protein, 34 aa, Brucella spp.
APLAIEGMMAFFLEATFVGLFFFGWDRLSKVGHL

SEQ ID NO: 21391 - protein, 17 aa, Brucella spp.
AGSNFSALWILIANGWM

SEQ ID NO: 21392 - protein, 20 aa, Brucella spp.
SNFSALWILIANGWMQNPVG

SEQ ID NO: 21393 - protein, 19 aa, Brucella spp.
TMRMEITDFFAVLTNPVAQ

SEQ ID NO: 21394 - protein, 28 aa, Brucella spp.
ARETHFAVRIPWVMGLIGTRSLTTPIEG

SEQ ID NO: 21395 - protein, 33 aa, Brucella spp.
DTVPGVLPLFWAFRIMVGIGFFLILLTGTFFVL

SEQ ID NO: 21396 - protein, 30 aa, Brucella spp.
LDRYPFLLKVAVFAIPLPWIAAEMGWVVAE

SEQ ID NO: 21397 - protein, 18 aa, Brucella spp.
PVLRLFFRSRAVALYAGI

SEQ ID NO: 21398 - protein, 20 aa, Brucella spp.
FRSRAVALYAGIAAATITVL

SEQ ID NO: 21399 - protein, 24 aa, Brucella spp.
HALLKRPARLLFRLTADIDALDSL

SEQ ID NO: 21400 - protein, 22 aa, Brucella spp.
DALDSLYLRVLVPIGAALATAL

SEQ ID NO: 21401 - protein, 20 aa, Brucella spp.
HPLFGLLVALTLLVIGLGLP

SEQ ID NO: 21402 - protein, 22 aa, Brucella spp.
LNRIEIATGAGLGIAHAAILAG

SEQ ID NO: 21403 - protein, 20 aa, Brucella spp.
APVAVLGILIILGAMEPFAA

SEQ ID NO: 21404 - protein, 20 aa, Brucella spp.
ACLPLPVPGQAVVLENVSVR

SEQ ID NO: 21405 - protein, 20 aa, Brucella spp.
GQARRLALARLFLTDAPLWE

SEQ ID NO: 21406 - protein, 17 aa, Brucella spp.
LALARLFLTDAPLWELD

SEQ ID NO: 21407 - protein, 18 aa, Brucella spp.
LWAAILVSFLLVAGAFLT

SEQ ID NO: 21408 - protein, 20 aa, Brucella spp.
GCIGLVRFKTFYERVHAPTI

SEQ ID NO: 21409 - protein, 20 aa, Brucella spp.
LLFVSLVLFWLLLNSFTRAQ

SEQ ID NO: 21410 - protein, 20 aa, Brucella spp.
RAQFILGLVIAFGACRVMMA

SEQ ID NO: 21411 - protein, 18 aa, Brucella spp.
RPLIEIFGVVDIVEGEKS

SEQ ID NO: 21412 - protein, 23 aa, Brucella spp.
RRRLKMAISFVSMVCLIALAITL

SEQ ID NO: 21413 - protein, 25 aa, Brucella spp.
LIGNWPAPFGIVLVLDRLAALMLVL

SEQ ID NO: 21414 - protein, 19 aa, Brucella spp.
IVLVLDRLAALMLVLASLL

SEQ ID NO: 21415 - protein, 18 aa, Brucella spp.
GDLFNLFVFFEVMLAASY

SEQ ID NO: 21416 - protein, 21 aa, Brucella spp.
AGMWPLNFWLAPAYTAAAAPV

SEQ ID NO: 21417 - protein, 29 aa, Brucella spp.
YGFGNDWLYFGGMITLAFGLIGVVASQAM

SEQ ID NO: 21418 - protein, 23 aa, Brucella spp.
CICAILLIGLPPFSGFLAKFLIL

SEQ ID NO: 21419 - protein, 18 aa, Brucella spp.
GNVPRVLVREVVPIAGLL

SEQ ID NO: 21420 - protein, 22 aa, Brucella spp.
LVREVVPIAGLLGVCLALTIAA

SEQ ID NO: 21421 - protein, 21 aa, Brucella spp.
WLILRPRTFQVAIGLSLVSYA

SEQ ID NO: 21422 - protein, 18 aa, Brucella spp.
FKTAELENLQAAYLKTCE

SEQ ID NO: 21423 - protein, 20 aa, Brucella spp.
WSAEEARAIYNLPFNDLLFR

SEQ ID NO: 21424 - protein, 18 aa, Brucella spp.
LPFNDLLFRAHGLHRENF

SEQ ID NO: 21425 - protein, 21 aa, Brucella spp.
IESVKAMGLETCMTLGMLDSD

SEQ ID NO: 21426 - protein, 18 aa, Brucella spp.
RFYPAVITTRSFEDRLDT

SEQ ID NO: 21427 - protein, 17 aa, Brucella spp.
VCSGGILGLGEEAEDRI

SEQ ID NO: 21428 - protein, 25 aa, Brucella spp.
EPPESVPINMLIPMPGTRLAKAAPV

SEQ ID NO: 21429 - protein, 27 aa, Brucella spp.
APVDPLEFVRVVALARILMPKSHVRLT

SEQ ID NO: 21430 - protein, 24 aa, Brucella spp.
MSDEMQALCFFAGANSLFMGDTLL

SEQ ID NO: 21431 - protein, 27 aa, Brucella spp.
RRRNLALADGLDFSSNDYLGLATHPGI

SEQ ID NO: 21432 - protein, 18 aa, Brucella spp.
FSSNDYLGLATHPGIKAA

SEQ ID NO: 21433 - protein, 17 aa, Brucella spp.
AAVEAALQRGVPLGATG

SEQ ID NO: 21434 - protein, 25 aa, Brucella spp.
AAAHFSAPRMIYFGSGYMANLAALS

SEQ ID NO: 21435 - protein, 18 aa, Brucella spp.
QPGDLIVYDELIHASAHA

SEQ ID NO: 21436 - protein, 25 aa, Brucella spp.
TLCDYLVNRASGFIFTTAPSPLQAA

SEQ ID NO: 21437 - protein, 25 aa, Brucella spp.
HGTARLRISITLNVGLADIDRMVET

SEQ ID NO: 21438 - protein, 18 aa, Brucella spp.
LDMISSWWVITHGHRHPA

SEQ ID NO: 21439 - protein, 26 aa, Brucella spp.
STAVEVAIKMALGYFYNRGEPRSRIA

SEQ ID NO: 21440 - protein, 23 aa, Brucella spp.
GGMKMYPAHILATMREITERHGV

SEQ ID NO: 21441 - protein, 22 aa, Brucella spp.
PIACAAALANLQVWLSEPVTER

SEQ ID NO: 21442 - protein, 24 aa, Brucella spp.
NGVLLRPLGNVIYVMPPYCVTAEE

SEQ ID NO: 21443 - protein, 17 aa, Brucella spp.
ADHMLSFYCPWEEVNDQ

SEQ ID NO: 21444 - protein, 19 aa, Brucella spp.
PFEEVTYWDEMRRVFDWTQ

SEQ ID NO: 21445 - protein, 18 aa, Brucella spp.
YWDEMRRVFDWTQSHVHR

SEQ ID NO: 21446 - protein, 19 aa, Brucella spp.
RSLVLASPYLRGFSDDFAI

SEQ ID NO: 21447 - protein, 23 aa, Brucella spp.
LRGFSDDFAIPVSRWTEVRKSDI

SEQ ID NO: 21448 - protein, 21 aa, Brucella spp.
WRSHAHLLFGNWINEMYQSTP

SEQ ID NO: 21449 - protein, 24 aa, Brucella spp.
NNVFWNYVLVYGLLAVGLFFTIRL

SEQ ID NO: 21450 - protein, 24 aa, Brucella spp.
LAVGLFFTIRLKFVQFVHFPELFR

SEQ ID NO: 21451 - protein, 29 aa, Brucella spp.
LKFVQFVHFPELFRVVFAAGRRDEAGISP

SEQ ID NO: 21452 - protein, 19 aa, Brucella spp.
PGAIFWMWIVALVGLATAY

SEQ ID NO: 21453 - protein, 21 aa, Brucella spp.
RGGPAFYIARGLGLPWAGALF

SEQ ID NO: 21454 - protein, 27 aa, Brucella spp.
AGALFSICLILSFGLVFNAVQANAIAD

SEQ ID NO: 21455 - protein, 19 aa, Brucella spp.
AFNMPKLGTGIVLAILSGV

SEQ ID NO: 21456 - protein, 19 aa, Brucella spp.
KLGTGIVLAILSGVVIFGG

SEQ ID NO: 21457 - protein, 24 aa, Brucella spp.
RVAEVVVPFMAFAYILMAICILAI

SEQ ID NO: 21458 - protein, 23 aa, Brucella spp.
TILRCALLAMVVWGAYESIHTVF

SEQ ID NO: 21459 - protein, 37 aa, Brucella spp.
KKYIRGGFAILIGLLGVFIILWAWQLPPFKHSVETTD

SEQ ID NO: 21460 - protein, 23 aa, Brucella spp.
TQLVSLVPAVKWIMANFKETQLY

SEQ ID NO: 21461 - protein, 17 aa, Brucella spp.
TQLYGMKVGQPVTLTVD

SEQ ID NO: 21462 - protein, 18 aa, Brucella spp.
VGQPVTLTVDALRHAELK

SEQ ID NO: 21463 - protein, 19 aa, Brucella spp.
CLVIIPMLAIFGSLVDEGT

SEQ ID NO: 21464 - protein, 23 aa, Brucella spp.
WLKRFELGTFADWRARISSVVMQ

SEQ ID NO: 21465 - protein, 27 aa, Brucella spp.
LQFFIGFGIMLYLLFFLFRDGADVGKK

SEQ ID NO: 21466 - protein, 25 aa, Brucella spp.
WLLGIEAALLWGVIMTFCSMLPAVG

SEQ ID NO: 21467 - protein, 25 aa, Brucella spp.
LYNKEPGIYVDIVSGEPLFASSDKY

SEQ ID NO: 21468 - protein, 23 aa, Brucella spp.
KYESHCGWPSFTKPIERANVTEL

SEQ ID NO: 21469 - protein, 18 aa, Brucella spp.
ENEIGVMLFHRVPHGAEL

SEQ ID NO: 21470 - protein, 23 aa, Brucella spp.
RGESGRLSLGFTASSAFNPIVSG

SEQ ID NO: 21471 - protein, 18 aa, Brucella spp.
RLPLSALAGEPFVLFPRI

SEQ ID NO: 21472 - protein, 29 aa, Brucella spp.
ALAGEPFVLFPRIVGLSLYDDIAAACRMA

SEQ ID NO: 21473 - protein, 24 aa, Brucella spp.
KGQVCFGTIDSWLIYKLTGGKAHV

SEQ ID NO: 21474 - protein, 19 aa, Brucella spp.
WDDELLDILGIPAAMLPEV

SEQ ID NO: 21475 - protein, 23 aa, Brucella spp.
ADFGMTDPALFGVSIPILGVAGD

SEQ ID NO: 21476 - protein, 17 aa, Brucella spp.
QRIYLVPAFTGLGAPYW

SEQ ID NO: 21477 - protein, 17 aa, Brucella spp.
YLVPAFTGLGAPYWDAE

SEQ ID NO: 21478 - protein, 19 aa, Brucella spp.
RAALESVAYQTFDLLEAMQ

SEQ ID NO: 21479 - protein, 18 aa, Brucella spp.
VFLETTVLGAAWLAASRA

SEQ ID NO: 21480 - protein, 25 aa, Brucella spp.
YPVDVDGNIGYPVVGNISVQGLTTL

SEQ ID NO: 21481 - protein, 29 aa, Brucella spp.
KAPGKYEFRPGMVALELMALGGGAGKGEA

SEQ ID NO: 21482 - protein, 17 aa, Brucella spp.
EAPSVTAGMQLISAQQE

SEQ ID NO: 21483 - protein, 24 aa, Brucella spp.
TRRDALELASFLARARQNQLAVEQ

SEQ ID NO: 21484 - protein, 23 aa, Brucella spp.
ADMRRKLIFTISRNVNGAYQEIA

SEQ ID NO: 21485 - protein, 25 aa, Brucella spp.
NERTEIKPGDILRIELDMSKLGGSP

SEQ ID NO: 21486 - protein, 32 aa, Brucella spp.
ETIKRRKLMLTLPIIAGVGVGFAGYLTAPVSY

SEQ ID NO: 21487 - protein, 19 aa, Brucella spp.
SVLVLDMRRLQALPNESAI

SEQ ID NO: 21488 - protein, 24 aa, Brucella spp.
SNDGRSFTIFISYRAPDPVYAARV

SEQ ID NO: 21489 - protein, 20 aa, Brucella spp.
DPVYAARVANAFATAYLNHQ

SEQ ID NO: 21490 - protein, 17 aa, Brucella spp.
ARVANAFATAYLNHQVD

SEQ ID NO: 21491 - protein, 23 aa, Brucella spp.
PAMTEILASPAIQNLRNEEARVQ

SEQ ID NO: 21492 - protein, 20 aa, Brucella spp.
LKSAEIPVLMAERESLKQQI

SEQ ID NO: 21493 - protein, 36 aa, Brucella spp.
AMAKASPRLINWLLVGLGLGGLFAVAGTMLREALDK

SEQ ID NO: 21494 - protein, 19 aa, Brucella spp.
ILVNRGVDSASPFGRAIKS

SEQ ID NO: 21495 - protein, 17 aa, Brucella spp.
VDSASPFGRAIKSVHDR

SEQ ID NO: 21496 - protein, 20 aa, Brucella spp.
EGEWLGELIAQLRPDHRIIL

SEQ ID NO: 21497 - protein, 22 aa, Brucella spp.
YEVERPLLVIIDSRALDRECLA

SEQ ID NO: 21498 - protein, 22 aa, Brucella spp.
VCVEALRLAMAGGTFVPASSVL

SEQ ID NO: 21499 - protein, 18 aa, Brucella spp.
RTEVACIINELFPSETAF

SEQ ID NO: 21500 - protein, 18 aa, Brucella spp.
RLAIGIAALAWSTGAVMA

SEQ ID NO: 21501 - protein, 20 aa, Brucella spp.
DAKSPIIFDTAYVYDPGSDG

SEQ ID NO: 21502 - protein, 22 aa, Brucella spp.
GLADGRIAIFGGYNKELFDKYL

SEQ ID NO: 21503 - protein, 17 aa, Brucella spp.
EAYRKLVDSYMGMKPEA

SEQ ID NO: 21504 - protein, 33 aa, Brucella spp.
FDGKDWKVAGKLPRGLAYGAAFDAPGGLLVVGG

SEQ ID NO: 21505 - protein, 17 aa, Brucella spp.
PFDNVASVVAYARAAEA

SEQ ID NO: 21506 - protein, 18 aa, Brucella spp.
RAAEASGASGLRIEGAAN

SEQ ID NO: 21507 - protein, 19 aa, Brucella spp.
CSRLGSFLIAEGRYNSPQQ

SEQ ID NO: 21508 - protein, 23 aa, Brucella spp.
SAITRPEHITGWFRDAVESAAKP

SEQ ID NO: 21509 - protein, 19 aa, Brucella spp.
SPVLAFDIGGTKTLAALVR

SEQ ID NO: 21510 - protein, 25 aa, Brucella spp.
LAIPPDYPLGRRMGAALGAPVEVIN

SEQ ID NO: 21511 - protein, 19 aa, Brucella spp.
AWGEYRFGAARGRDMVFLT

SEQ ID NO: 21512 - protein, 19 aa, Brucella spp.
YRFGAARGRDMVFLTISSG

SEQ ID NO: 21513 - protein, 21 aa, Brucella spp.
SGIGGGIVLGGRLIRGARGIA

SEQ ID NO: 21514 - protein, 24 aa, Brucella spp.
AAAGEGWARRILLDAASQLAAAVA

SEQ ID NO: 21515 - protein, 29 aa, Brucella spp.
NFNPLAATGGFTWLVTYFEPLVIYDDKLE

SEQ ID NO: 21516 - protein, 22 aa, Brucella spp.
TSKDAKFTFDLARNGKTGSVFA

SEQ ID NO: 21517 - protein, 29 aa, Brucella spp.
FNQEVPLWKDLKVRQAFMHAINRDAIIQS

SEQ ID NO: 21518 - protein, 24 aa, Brucella spp.
GGTADEFPLIFAGLQNGPDPSSIN

SEQ ID NO: 21519 - protein, 24 aa, Brucella spp.
ATNANLPWGTMWVANRYGVASSKL

SEQ ID NO: 21520 - protein, 17 aa, Brucella spp.
LTYPLWLPYKPNDIDLM

SEQ ID NO: 21521 - protein, 18 aa, Brucella spp.
GLPNSIDILVVYATLQVA

SEQ ID NO: 21522 - protein, 24 aa, Brucella spp.
AVLEQFPWQWLFPGGALVLAVLAI

SEQ ID NO: 21523 - protein, 19 aa, Brucella spp.
PEKAAAFVAQFGGMVSPTI

SEQ ID NO: 21524 - protein, 20 aa, Brucella spp.
EALALKPDLAVVMGRPAEMA

SEQ ID NO: 21525 - protein, 25 aa, Brucella spp.
RNAFVSVALPYCFSPLLAEADALRD

SEQ ID NO: 21526 - protein, 18 aa, Brucella spp.
QRYVNDGVAWVLDASISG

SEQ ID NO: 21527 - protein, 17 aa, Brucella spp.
VNDGVAWVLDASISGGG

SEQ ID NO: 21528 - protein, 20 aa, Brucella spp.
AVTLRDLWRAMDLIDRCYAL

SEQ ID NO: 21529 - protein, 23 aa, Brucella spp.
VAHSDYLGWSLFSYDDVVRVLDD

SEQ ID NO: 21530 - protein, 17 aa, Brucella spp.
RDAEIDLVTQFAQLYAV

SEQ ID NO: 21531 - protein, 23 aa, Brucella spp.
QLYAVRIQCAFLGWPDSLQGPLL

SEQ ID NO: 21532 - protein, 24 aa, Brucella spp.
AFLGWPDSLQGPLLDWVHKNHAAT

SEQ ID NO: 21533 - protein, 22 aa, Brucella spp.
ITACVGILCHYLAKSQQTQALM

SEQ ID NO: 21534 - protein, 18 aa, Brucella spp.
AIDEILRLHAPLISNRRV

SEQ ID NO: 21535 - protein, 24 aa, Brucella spp.
GREIPAGEKITLMWASANRDEAVF

SEQ ID NO: 21536 - protein, 25 aa, Brucella spp.
AEHIDPSRILAVGHRVVFGGDDFAQ

SEQ ID NO: 21537 - protein, 24 aa, Brucella spp.
NLEAIERLSIFAPLHQPKSLALIK

SEQ ID NO: 21538 - protein, 18 aa, Brucella spp.
RKIFPHLAQTASFDTAFH

SEQ ID NO: 21539 - protein, 17 aa, Brucella spp.
LAQTASFDTAFHQTIPD

SEQ ID NO: 21540 - protein, 17 aa, Brucella spp.
DTVRRFAIPQELHDRGI

SEQ ID NO: 21541 - protein, 17 aa, Brucella spp.
RGIKRFGFHGLSYKSVI

SEQ ID NO: 21542 - protein, 18 aa, Brucella spp.
RFGFHGLSYKSVIGNFSQ

SEQ ID NO: 21543 - protein, 17 aa, Brucella spp.
DTSMSFSTLDGIPMATR

SEQ ID NO: 21544 - protein, 17 aa, Brucella spp.
LLYHRSGLLGLSGLSGD

SEQ ID NO: 21545 - protein, 18 aa, Brucella spp.
LDIFALRIAGEICRLAST

SEQ ID NO: 21546 - protein, 24 aa, Brucella spp.
AIRAAICQRLAWQGVELDPAANDE

SEQ ID NO: 21547 - protein, 17 aa, Brucella spp.
LINRYWRAANYLSVGQI

SEQ ID NO: 21548 - protein, 18 aa, Brucella spp.
ANYLSVGQIYLMKNPLLR

SEQ ID NO: 21549 - protein, 32 aa, Brucella spp.
QPEHIKPRLLGHWGTTPGLNFIYAHLNRIIQQ

SEQ ID NO: 21550 - protein, 20 aa, Brucella spp.
AGMERLFRQFSFPGGIPSHA

SEQ ID NO: 21551 - protein, 23 aa, Brucella spp.
ARDGAVLPILHLNGYKIANPTVL

SEQ ID NO: 21552 - protein, 17 aa, Brucella spp.
QKMAATLDTIFQRIQDI

SEQ ID NO: 21553 - protein, 25 aa, Brucella spp.
PERPRWPMIILRSPKGWTGPKTVDG

SEQ ID NO: 21554 - protein, 20 aa, Brucella spp.
EAQSTKILGDFLRDVMKLNE

SEQ ID NO: 21555 - protein, 25 aa, Brucella spp.
SEHLCQGWLEGYLLSGRHGFFSCYE

SEQ ID NO: 21556 - protein, 18 aa, Brucella spp.
GFFSCYEAFIHIIDSMFN

SEQ ID NO: 21557 - protein, 23 aa, Brucella spp.
KWLQVARELEWRKPISSLNYLLT

SEQ ID NO: 21558 - protein, 25 aa, Brucella spp.
RVYFPPDANTLLWVGDHCLKTWNRV

SEQ ID NO: 21559 - protein, 20 aa, Brucella spp.
GDHCLKTWNRVNVIVAGKQP

SEQ ID NO: 21560 - protein, 23 aa, Brucella spp.
KHCEAGLGIWEWAGTEDGLEPDI

SEQ ID NO: 21561 - protein, 21 aa, Brucella spp.
PHLRIRVVNVVDLMVLQSPHQ

SEQ ID NO: 21562 - protein, 19 aa, Brucella spp.
FTTNRPVIFAYHGYPYLIH

SEQ ID NO: 21563 - protein, 23 aa, Brucella spp.
FAYHGYPYLIHRLVYKRTNHSNF

SEQ ID NO: 21564 - protein, 18 aa, Brucella spp.
TVLNELDRFHLAMEAVER

SEQ ID NO: 21565 - protein, 19 aa, Brucella spp.
ECIEALLVVGILNAWLSHR

SEQ ID NO: 21566 - protein, 18 aa, Brucella spp.
WLGVFALAALAVMREGSE

SEQ ID NO: 21567 - protein, 19 aa, Brucella spp.
FRITEVMLLFLAGSLLLTG

SEQ ID NO: 21568 - protein, 29 aa, Brucella spp.
RARPVLIEVLVFFAYWTIVLWFLSRPRAL

SEQ ID NO: 21569 - protein, 19 aa, Brucella spp.
ALMVPLSLALAYGAQAKEI

SEQ ID NO: 21570 - protein, 22 aa, Brucella spp.
FAEGDWVPYLVVSYELTHLDNG

SEQ ID NO: 21571 - protein, 21 aa, Brucella spp.
LDGPGKYKLKLFVSPPSANQH

SEQ ID NO: 21572 - protein, 21 aa, Brucella spp.
KETGVGPWFKPVTAEYEFVYA

SEQ ID NO: 21573 - protein, 26 aa, Brucella spp.
ADAEYGRHLAKLFTPLMIGVGPVEAA

SEQ ID NO: 21574 - protein, 22 aa, Brucella spp.
IGFEKGVTPFLDLPETVELPFR

SEQ ID NO: 21575 - protein, 26 aa, Brucella spp.
PFLDLPETVELPFRVAGIDTASLSTG

SEQ ID NO: 21576 - protein, 22 aa, Brucella spp.
ACQAVGVPLLGLRGISDGASEL

SEQ ID NO: 21577 - protein, 17 aa, Brucella spp.
PDFKERVEESFGRQAAM

SEQ ID NO: 21578 - protein, 21 aa, Brucella spp.
AVLTIEFKVNLLAPGKGERFL

SEQ ID NO: 21579 - protein, 20 aa, Brucella spp.
FKVNLLAPGKGERFLFRGEV

SEQ ID NO: 21580 - protein, 18 aa, Brucella spp.
VPCPLCLLQRMAMFGVCF

SEQ ID NO: 21581 - protein, 24 aa, Brucella spp.
MFGVCFGVMLQLRYGPSFRFSGIG

SEQ ID NO: 21582 - protein, 18 aa, Brucella spp.
FRFSGIGLLFAIVLLIIS

SEQ ID NO: 21583 - protein, 18 aa, Brucella spp.
HMPVWSILIALALIAAFA

SEQ ID NO: 21584 - protein, 23 aa, Brucella spp.
LRSSMVLALYWLFMCWRLQRSTW

SEQ ID NO: 21585 - protein, 22 aa, Brucella spp.
MTIAMWFCWFGRLSIALVCMFL

SEQ ID NO: 21586 - protein, 22 aa, Brucella spp.
FFVRDPLKFPDFIHTQKRHPRT

SEQ ID NO: 21587 - protein, 24 aa, Brucella spp.
RTHLRSATAMWDFWSLSPESLHQV

SEQ ID NO: 21588 - protein, 19 aa, Brucella spp.
AGERYWVKFHFKTMQGHKH

SEQ ID NO: 21589 - protein, 24 aa, Brucella spp.
FSAIENGEFPKWKVQVQIMPELDA

SEQ ID NO: 21590 - protein, 17 aa, Brucella spp.
PYNPFDLTKVWPHADYP

SEQ ID NO: 21591 - protein, 19 aa, Brucella spp.
DLTKVWPHADYPPIDIGVM

SEQ ID NO: 21592 - protein, 22 aa, Brucella spp.
FSPSNIVPGIGFSPDKMLQARI

SEQ ID NO: 21593 - protein, 17 aa, Brucella spp.
DKMLQARIFSYADAHRH

SEQ ID NO: 21594 - protein, 17 aa, Brucella spp.
MLQARIFSYADAHRHRL

SEQ ID NO: 21595 - protein, 17 aa, Brucella spp.
YSQPRALFNLFDAAQKQ

SEQ ID NO: 21596 - protein, 21 aa, Brucella spp.
MKGVPGFIVERQLGHFKLIHP

SEQ ID NO: 21597 - protein, 17 aa, Brucella spp.
GVRKALKDAHGYDANTI

SEQ ID NO: 21598 - protein, 19 aa, Brucella spp.
CLSLGYFAATSDSSRSKPA

SEQ ID NO: 21599 - protein, 17 aa, Brucella spp.
KQYGLPLVGVYGDFPQY

SEQ ID NO: 21600 - protein, 24 aa, Brucella spp.
SAEMKAMVAYIKYVSAGTVVGEET

SEQ ID NO: 21601 - protein, 27 aa, Brucella spp.
GDAKSYEFPPLWGPDSFNDGAGMNRLI

SEQ ID NO: 21602 - protein, 17 aa, Brucella spp.
AGMNRLISAANFIHANM

SEQ ID NO: 21603 - protein, 25 aa, Brucella spp.
QLEPEDAWDIAAFFQSKPRPAKANL

SEQ ID NO: 21604 - protein, 18 aa, Brucella spp.
AQVHKVGPFEEIRAEIKK

SEQ ID NO: 21605 - protein, 17 aa, Brucella spp.
GALALTFDDVLLQPGHS

SEQ ID NO: 21606 - protein, 23 aa, Brucella spp.
IAKDIELNLPLLSAAMDTVTESR

SEQ ID NO: 21607 - protein, 18 aa, Brucella spp.
SRLAIAMAQAGGIGVIHR

SEQ ID NO: 21608 - protein, 17 aa, Brucella spp.
ALMKAHGISGIPVVENA

SEQ ID NO: 21609 - protein, 17 aa, Brucella spp.
MKAHGISGIPVVENATK

SEQ ID NO: 21610 - protein, 19 aa, Brucella spp.
GPGRLVGILTNRDVRFASD

SEQ ID NO: 21611 - protein, 19 aa, Brucella spp.
SICTTRIVAGVGVPQLSAI

SEQ ID NO: 21612 - protein, 26 aa, Brucella spp.
VIADGGIKFSGDFAKALAAGAVAAMA

SEQ ID NO: 21613 - protein, 26 aa, Brucella spp.
LHQGRSFKAYRGMGSVGAMARGSADR

SEQ ID NO: 21614 - protein, 20 aa, Brucella spp.
KLVPEGIEGQVAYKGPISAV

SEQ ID NO: 21615 - protein, 18 aa, Brucella spp.
EGQVAYKGPISAVLHQLA

SEQ ID NO: 21616 - protein, 21 aa, Brucella spp.
LAGGLRASMGYVGAKTLEEFR

SEQ ID NO: 21617 - protein, 21 aa, Brucella spp.
FREKATFVRISNAGLRESHSH

SEQ ID NO: 21618 - protein, 17 aa, Brucella spp.
GALAIGIISVGFAEAAD

SEQ ID NO: 21619 - protein, 25 aa, Brucella spp.
SGSPLRAWLPLLITPLGFMFCSWVA

SEQ ID NO: 21620 - protein, 21 aa, Brucella spp.
GFMFCSWVALVWFPNSGGSGI

SEQ ID NO: 21621 - protein, 17 aa, Brucella spp.
WVALVWFPNSGGSGIPQ

SEQ ID NO: 21622 - protein, 17 aa, Brucella spp.
SAVEGATLPPFYFVEKF

SEQ ID NO: 21623 - protein, 21 aa, Brucella spp.
VEGATLPPFYFVEKFTVGLLS

SEQ ID NO: 21624 - protein, 17 aa, Brucella spp.
SLAGLGAMPFAVNTASA

SEQ ID NO: 21625 - protein, 24 aa, Brucella spp.
GTRETDLLDPINFVQKVQAILLSG

SEQ ID NO: 21626 - protein, 25 aa, Brucella spp.
MRYLEENNLGFEIGKGVVPIVPAAI

SEQ ID NO: 21627 - protein, 18 aa, Brucella spp.
KMFGMDYAMKGGLGTASY

SEQ ID NO: 21628 - protein, 18 aa, Brucella spp.
YAMKGGLGTASYKVPGTE

SEQ ID NO: 21629 - protein, 20 aa, Brucella spp.
LKKIAGMAHDGFARTINPVH

SEQ ID NO: 21630 - protein, 24 aa, Brucella spp.
VHTMWDGDTIFALSTGKAKDGQAD

SEQ ID NO: 21631 - protein, 20 aa, Brucella spp.
AQFPGRYRFDGSMSSNSLKF

SEQ ID NO: 21632 - protein, 24 aa, Brucella spp.
LNGLPAYAYTMAFVQMLAAKGQLQ

SEQ ID NO: 21633 - protein, 18 aa, Brucella spp.
SSVARDLLMYLLTTLGVE

SEQ ID NO: 21634 - protein, 17 aa, Brucella spp.
RDLLMYLLTTLGVEPVA

SEQ ID NO: 21635 - protein, 26 aa, Brucella spp.
TEALRPEDIALLAQWGKSDRLDAIVS

SEQ ID NO: 21636 - protein, 20 aa, Brucella spp.
RGDLAGAITATWVGADTLVT

SEQ ID NO: 21637 - protein, 23 aa, Brucella spp.
ALESRFPKVLRTRVGSPYVIASM

SEQ ID NO: 21638 - protein, 17 aa, Brucella spp.
ANGGVLLGSTVERNGRS

SEQ ID NO: 21639 - protein, 21 aa, Brucella spp.
RDALLPILACLATVHEKKTPL

SEQ ID NO: 21640 - protein, 22 aa, Brucella spp.
STIARSYGFRVALSDRLQNIPQ

SEQ ID NO: 21641 - protein, 23 aa, Brucella spp.
QNIPQEASTAFLALLEDADKRAS

SEQ ID NO: 21642 - protein, 23 aa, Brucella spp.
VRVETIDGVKLFFQSGNAVHYRA

SEQ ID NO: 21643 - protein, 25 aa, Brucella spp.
EESFKPTVVGWVVGFNKKGKEEDAV

SEQ ID NO: 21644 - protein, 19 aa, Brucella spp.
KQEPKASFWKKAEAELKKV

SEQ ID NO: 21645 - protein, 27 aa, Brucella spp.
VGEAFGPRWGFLAIFLVWVESTIWFPT

SEQ ID NO: 21646 - protein, 19 aa, Brucella spp.
STIWFPTVLTFGAVAIAFA

SEQ ID NO: 21647 - protein, 21 aa, Brucella spp.
YRVPFGAFGMWLFAGVGLVGS

SEQ ID NO: 21648 - protein, 17 aa, Brucella spp.
RVLELQREYLIELGDAV

SEQ ID NO: 21649 - protein, 21 aa, Brucella spp.
LELQREYLIELGDAVVVVKDS

SEQ ID NO: 21650 - protein, 17 aa, Brucella spp.
YLIELGDAVVVVKDSDG

SEQ ID NO: 21651 - protein, 28 aa, Brucella spp.
SGALWGTLIGFIFFMPLVGTALGAATGA

SEQ ID NO: 21652 - protein, 23 aa, Brucella spp.
VLQPGSAGLFLLIRKMTTDKVLA

SEQ ID NO: 21653 - protein, 24 aa, Brucella spp.
IKYLEGGLTPAMFHQRLAEMVQKL

SEQ ID NO: 21654 - protein, 17 aa, Brucella spp.
ALIVDHFVWAYCPSVAA

SEQ ID NO: 21655 - protein, 17 aa, Brucella spp.
SADELDVLVTLPLTQNL

SEQ ID NO: 21656 - protein, 17 aa, Brucella spp.
VLVTLPLTQNLLDQIDS

SEQ ID NO: 21657 - protein, 17 aa, Brucella spp.
AVKKSGQALNWKTSIVD

SEQ ID NO: 21658 - protein, 33 aa, Brucella spp.
KKSGQALNWKTSIVDLIKALGLDSSLQHRKELA

SEQ ID NO: 21659 - protein, 20 aa, Brucella spp.
LREEILAVIAKHIKVDREKV

SEQ ID NO: 21660 - protein, 22 aa, Brucella spp.
LVIGAERRVVYDFVNVIQGDAK

SEQ ID NO: 21661 - protein, 19 aa, Brucella spp.
IRDKRLETLYLLPASQTRD

SEQ ID NO: 21662 - protein, 18 aa, Brucella spp.
LETLYLLPASQTRDKDTL

SEQ ID NO: 21663 - protein, 24 aa, Brucella spp.
LVIDQLKKSFDWVICDSPAGIERG

SEQ ID NO: 21664 - protein, 28 aa, Brucella spp.
KVEDVLEILSIPLLGIIPESQDVLRASN

SEQ ID NO: 21665 - protein, 19 aa, Brucella spp.
LEVWNRLTGNFWLPEKVPL

SEQ ID NO: 21666 - protein, 17 aa, Brucella spp.
HEEAVLSNISFMEAVHA

SEQ ID NO: 21667 - protein, 19 aa, Brucella spp.
EAVLSNISFMEAVHARSYS

SEQ ID NO: 21668 - protein, 35 aa, Brucella spp.
KKKIASVFLESFLFYSGFYLPMYWSSRAKLTNTAD

SEQ ID NO: 21669 - protein, 25 aa, Brucella spp.
DEAVHGYYIGYKFQRALEVLSEEKR

SEQ ID NO: 21670 - protein, 24 aa, Brucella spp.
QEIKDFAFELLLELYDNEVRYTEA

SEQ ID NO: 21671 - protein, 23 aa, Brucella spp.
QTVLDQYSFNFVRDLFDEAYARK

SEQ ID NO: 21672 - protein, 35 aa, Brucella spp.
DLFDEAYARKFRFPTFLGAFKYYTSYTLKTFDGKR

SEQ ID NO: 21673 - protein, 17 aa, Brucella spp.
YYTSYTLKTFDGKRYLE

SEQ ID NO: 21674 - protein, 22 aa, Brucella spp.
YEDRVCMVALTLARGDEQLARD

SEQ ID NO: 21675 - protein, 25 aa, Brucella spp.
KKQRGELVSCFLLRVEDNMESIGRS

SEQ ID NO: 21676 - protein, 23 aa, Brucella spp.
LSKRGGGVALCLTNLREAGAPIK

SEQ ID NO: 21677 - protein, 18 aa, Brucella spp.
ENQSSGIIPVMKLLEDSF

SEQ ID NO: 21678 - protein, 24 aa, Brucella spp.
EIQFESGYPYIMFEDTVNRANPID

SEQ ID NO: 21679 - protein, 23 aa, Brucella spp.
SEEGVDFTNIYFYTVAYHAVRAS

SEQ ID NO: 21680 - protein, 17 aa, Brucella spp.
VETGKSFKGFEKSKYAS

SEQ ID NO: 21681 - protein, 20 aa, Brucella spp.
EGKIGRVYYPAAFMTNDNLE

SEQ ID NO: 21682 - protein, 24 aa, Brucella spp.
QHVDQGLSLTLFFRDTATTRDINR

SEQ ID NO: 21683 - protein, 25 aa, Brucella spp.
YAWKKGIKTIYYIRLRQMALEGTQV

SEQ ID NO: 21684 - protein, 17 aa, Brucella spp.
TKPGVGFPKEWENQKKW

SEQ ID NO: 21685 - protein, 23 aa, Brucella spp.
IEPKMGAKWRILAKIFANPDLPE

SEQ ID NO: 21686 - protein, 18 aa, Brucella spp.
IEWGPNWEEILGGEFAKR

SEQ ID NO: 21687 - protein, 19 aa, Brucella spp.
GQFENTFMMYLPRLCEHCL

SEQ ID NO: 21688 - protein, 18 aa, Brucella spp.
TFMMYLPRLCEHCLNPTC

SEQ ID NO: 21689 - protein, 22 aa, Brucella spp.
SGKSEKCIFCYPRIESGQPTVC

SEQ ID NO: 21690 - protein, 23 aa, Brucella spp.
ETCVGRIRYLGVMLYDADRISEA

SEQ ID NO: 21691 - protein, 41 aa, Brucella spp.
KHSPVYKMAMDWKIAFPLHPEYRTLPMVWYVPPFSPLQSAA

SEQ ID NO: 21692 - protein, 21 aa, Brucella spp.
RSMRIPVRYLANLLTAGKEEP

SEQ ID NO: 21693 - protein, 17 aa, Brucella spp.
DAYDVRGSCGFTFGNGC

SEQ ID NO: 21694 - protein, 19 aa, Brucella spp.
VRGSCGFTFGNGCSGGTST

SEQ ID NO: 21695 - protein, 18 aa, Brucella spp.
SLLLFYPSPELQAGRAEL

SEQ ID NO: 21696 - protein, 19 aa, Brucella spp.
RTRSLSLHLFEHVHGESRD

SEQ ID NO: 21697 - protein, 28 aa, Brucella spp.
IDAKELPDYLPLFLEFLSTRSTEEIHDL

SEQ ID NO: 21698 - protein, 25 aa, Brucella spp.
GSVLFHLGVLVIFAGHFVGLLTPIW

SEQ ID NO: 21699 - protein, 24 aa, Brucella spp.
SRPSDTLIIILLWVQLLLGLSSIP

SEQ ID NO: 21700 - protein, 33 aa, Brucella spp.
ASIVFKMHIFLGLTIFILFPFTRLVHMLSAPVR

SEQ ID NO: 21701 - protein, 22 aa, Brucella spp.
ELEAGAQLLILNRFGKGETEGH

SEQ ID NO: 21702 - protein, 19 aa, Brucella spp.
SLIPLKLLERLAVMEEVET

SEQ ID NO: 21703 - protein, 25 aa, Brucella spp.
ELGANGYSLLYRLAARTYAVEDVGA

SEQ ID NO: 21704 - protein, 22 aa, Brucella spp.
HLKERRKLVLIARETPLHLVHL

SEQ ID NO: 21705 - protein, 17 aa, Brucella spp.
ETPLHLVHLRNMCTVTE

SEQ ID NO: 21706 - protein, 25 aa, Brucella spp.
EMGAIVMPPVPAFYLQPQTVEDVAS

SEQ ID NO: 21707 - protein, 23 aa, Brucella spp.
NLFGSERRIAWGLGRLPEELPLL

SEQ ID NO: 21708 - protein, 17 aa, Brucella spp.
DTLPIQWCWPGEPAPLI

SEQ ID NO: 21709 - protein, 31 aa, Brucella spp.
LPIQWCWPGEPAPLITWPLVITRAPDDPSDV

SEQ ID NO: 21710 - protein, 24 aa, Brucella spp.
KRGEDMPVAIAIGVDPATILAAVM

SEQ ID NO: 21711 - protein, 22 aa, Brucella spp.
GMSELAFSGLLGGRRPCVTQGR

SEQ ID NO: 21712 - protein, 21 aa, Brucella spp.
SVEAFPVMQVTAITMRKKPVY

SEQ ID NO: 21713 - protein, 19 aa, Brucella spp.
GEVMNQLFVPVVRKQFPEI

SEQ ID NO: 21714 - protein, 24 aa, Brucella spp.
KQFPEIADLWLPPAACSYRAMVVS

SEQ ID NO: 21715 - protein, 31 aa, Brucella spp.
GQARRVMMGLWSMLPQFSYTKLIIAVDPDID

SEQ ID NO: 21716 - protein, 24 aa, Brucella spp.
AAPARLVPPFLLNPLVSRVFHQVI

SEQ ID NO: 21717 - protein, 17 aa, Brucella spp.
RAHPGLFERLGEHVNKR

SEQ ID NO: 21718 - protein, 25 aa, Brucella spp.
FGFRPSDLPFTFLVEPGKPRISVFR

SEQ ID NO: 21719 - protein, 24 aa, Brucella spp.
DAAIEGPLVMLLALLEGKLDGDAL

SEQ ID NO: 21720 - protein, 22 aa, Brucella spp.
ELKDVQISFRLADGGRFDAVAE

SEQ ID NO: 21721 - protein, 17 aa, Brucella spp.
YLFQQDALMPWKTVLEN

SEQ ID NO: 21722 - protein, 19 aa, Brucella spp.
QDALMPWKTVLENVAIGLE

SEQ ID NO: 21723 - protein, 24 aa, Brucella spp.
REQAREWLNKVGLGTFGDRYPHML

SEQ ID NO: 21724 - protein, 19 aa, Brucella spp.
RVIMGDLLLDLWSQDKKAV

SEQ ID NO: 21725 - protein, 18 aa, Brucella spp.
EYRIPLARPREISEIRLD

SEQ ID NO: 21726 - protein, 24 aa, Brucella spp.
PRGLKMTGPVILSYGFRPFFLGGA

SEQ ID NO: 21727 - protein, 19 aa, Brucella spp.
LSYGFRPFFLGGAIWAVMA

SEQ ID NO: 21728 - protein, 18 aa, Brucella spp.
RPFFLGGAIWAVMAMLLW

SEQ ID NO: 21729 - protein, 23 aa, Brucella spp.
AIESLFLPFLLFIAAREIIAGHH

SEQ ID NO: 21730 - protein, 17 aa, Brucella spp.
AAREIIAGHHWRNLKVL

SEQ ID NO: 21731 - protein, 17 aa, Brucella spp.
IAGHHWRNLKVLGGIAG

SEQ ID NO: 21732 - protein, 17 aa, Brucella spp.
VVACLSWIFLPESSLTA

SEQ ID NO: 21733 - protein, 17 aa, Brucella spp.
DFDALGLSMEIKIKMRN

SEQ ID NO: 21734 - protein, 24 aa, Brucella spp.
NTAIKFAAAGLFALLAAPALAENI

SEQ ID NO: 21735 - protein, 19 aa, Brucella spp.
AEGAMVFEPSYIKANAGDT

SEQ ID NO: 21736 - protein, 24 aa, Brucella spp.
IKCTPHYAMSMVALIAVGDKPENL

SEQ ID NO: 21737 - protein, 22 aa, Brucella spp.
LRPTNEPIWFSSARDTLAFTML

SEQ ID NO: 21738 - protein, 18 aa, Brucella spp.
LRNRWVLATTLLLAALAL

SEQ ID NO: 21739 - protein, 20 aa, Brucella spp.
ERGTMLLLLSYPLSRIQVVL

SEQ ID NO: 21740 - protein, 19 aa, Brucella spp.
ASWISFLKLIGSSILLGAV

SEQ ID NO: 21741 - protein, 20 aa, Brucella spp.
IAIGVWLFFVLIYDAALLVF

SEQ ID NO: 21742 - protein, 17 aa, Brucella spp.
AVLPLSLSMLVFSRKEL

SEQ ID NO: 21743 - protein, 18 aa, Brucella spp.
TTMIKLMLGLIRPTKGAV

SEQ ID NO: 21744 - protein, 37 aa, Brucella spp.
AGAFAARLRLGYLPEHVSFNMALTGAETLGFYARLKQ

SEQ ID NO: 21745 - protein, 18 aa, Brucella spp.
MRQRLGLAQALLGQPAVL

SEQ ID NO: 21746 - protein, 25 aa, Brucella spp.
CLPVETGNLLLRWHRLGPDLYETEA

SEQ ID NO: 21747 - protein, 17 aa, Brucella spp.
PGDVVRLRAGRHEGAVV

SEQ ID NO: 21748 - protein, 22 aa, Brucella spp.
DNLPDLHSGIFVSRTATGARVE

SEQ ID NO: 21749 - protein, 18 aa, Brucella spp.
RMAETGSGVSVWNAPGAQ

SEQ ID NO: 21750 - protein, 25 aa, Brucella spp.
VSRNNSVGFAIMYTNRLKILNNVSE

SEQ ID NO: 21751 - protein, 17 aa, Brucella spp.
RDHGLLLNYANSSIITG

SEQ ID NO: 21752 - protein, 20 aa, Brucella spp.
GRMQPIERWLEAGLQKGEHG

SEQ ID NO: 21753 - protein, 19 aa, Brucella spp.
SFENCSIGIHFTAGSEGNA

SEQ ID NO: 21754 - protein, 17 aa, Brucella spp.
CSIGIHFTAGSEGNAMS

SEQ ID NO: 21755 - protein, 18 aa, Brucella spp.
YRPNDLIDRVLWTVPQAK

SEQ ID NO: 21756 - protein, 20 aa, Brucella spp.
AVDTIRWAQTQFPALLPGGV

SEQ ID NO: 21757 - protein, 21 aa, Brucella spp.
WAQTQFPALLPGGVVDSHPLM

SEQ ID NO: 21758 - protein, 18 aa, Brucella spp.
VDHKEPIVLIGIPEPKVV

SEQ ID NO: 21759 - protein, 20 aa, Brucella spp.
PIVLIGIPEPKVVAALNSLV

SEQ ID NO: 21760 - protein, 22 aa, Brucella spp.
GIPEPKVVAALNSLVNSDMTAV

SEQ ID NO: 21761 - protein, 20 aa, Brucella spp.
PSLREIALFRVPEGFAFDVT

SEQ ID NO: 21762 - protein, 28 aa, Brucella spp.
LFRVPEGFAFDVTRPWDMQLLVQRGFGA

SEQ ID NO: 21763 - protein, 21 aa, Brucella spp.
GISILILVAIFFFQDSLVRHP

SEQ ID NO: 21764 - protein, 17 aa, Brucella spp.
VRHPRFFTWLRRGYLLF

SEQ ID NO: 21765 - protein, 28 aa, Brucella spp.
RFFTWLRRGYLLFILVWLGFYNHAQLSV

SEQ ID NO: 21766 - protein, 27 aa, Brucella spp.
ITGFNWEFFLTSPLIFILWGATAAGLL

SEQ ID NO: 21767 - protein, 22 aa, Brucella spp.
KVPQVKLPWGLHERLWPLKYII

SEQ ID NO: 21768 - protein, 27 aa, Brucella spp.
HERLWPLKYIIFLGLFALSLYSMALAE

SEQ ID NO: 21769 - protein, 32 aa, Brucella spp.
VEPFKTSIILKFARDWPFVIYALTLLAVGLFV

SEQ ID NO: 21770 - protein, 18 aa, Brucella spp.
PLGAALAIPGRIRMFEWL

SEQ ID NO: 21771 - protein, 22 aa, Brucella spp.
AIPGRIRMFEWLKRWQECGSPC

SEQ ID NO: 21772 - protein, 25 aa, Brucella spp.
YRLIPSCFPPIGLFDTVATAADLEA

SEQ ID NO: 21773 - protein, 22 aa, Brucella spp.
ADLEAVMELAGWTNDRLVEERL

SEQ ID NO: 21774 - protein, 21 aa, Brucella spp.
ERLYRLARTEWVFGRTNSSIV

SEQ ID NO: 21775 - protein, 20 aa, Brucella spp.
FNGSELGAWYSAAKLTTAII

SEQ ID NO: 21776 - protein, 26 aa, Brucella spp.
AISPEMETPKLLWLKEHKPETFAAAW

SEQ ID NO: 21777 - protein, 35 aa, Brucella spp.
KEHKPETFAAAWQFFDLTDFLTWKSCGSLARSACT

SEQ ID NO: 21778 - protein, 19 aa, Brucella spp.
WKSCGSLARSACTVTCKWT

SEQ ID NO: 21779 - protein, 17 aa, Brucella spp.
VTCKWTYLSHEKRWDET

SEQ ID NO: 21780 - protein, 17 aa, Brucella spp.
KRWDETYFRAVGLGELA

SEQ ID NO: 21781 - protein, 17 aa, Brucella spp.
ETYFRAVGLGELADESF

SEQ ID NO: 21782 - protein, 23 aa, Brucella spp.
EGRILSRMAYVFGTSACTMTTTE

SEQ ID NO: 21783 - protein, 22 aa, Brucella spp.
QPVFVDGVWGPYFSAMVPGLWL

SEQ ID NO: 21784 - protein, 25 aa, Brucella spp.
VWGPYFSAMVPGLWLNEGGQSAAGA

SEQ ID NO: 21785 - protein, 18 aa, Brucella spp.
IHVVPEFLGNRAPFADPD

SEQ ID NO: 21786 - protein, 18 aa, Brucella spp.
AALYLAGLCGLGYGVRQI

SEQ ID NO: 21787 - protein, 17 aa, Brucella spp.
GLCGLGYGVRQIIEAQR

SEQ ID NO: 21788 - protein, 18 aa, Brucella spp.
DRMLNLNINAAFRTVHAV

SEQ ID NO: 21789 - protein, 24 aa, Brucella spp.
PKEVAESVMFMLTRPRNITIRDLV

SEQ ID NO: 21790 - protein, 26 aa, Brucella spp.
DLGSLPVIIGLLIIWTVFQTLNPVFL

SEQ ID NO: 21791 - protein, 18 aa, Brucella spp.
NNGWPVGVAIIAALCAGA

SEQ ID NO: 21792 - protein, 19 aa, Brucella spp.
AALCAGALAGFLYALLYNR

SEQ ID NO: 21793 - protein, 19 aa, Brucella spp.
AGALAGFLYALLYNRFSMP

SEQ ID NO: 21794 - protein, 19 aa, Brucella spp.
LLVMPRPLSYALALVAGLA

SEQ ID NO: 21795 - protein, 26 aa, Brucella spp.
NQSRGVPWMFALFVALVIAMNYALTR

SEQ ID NO: 21796 - protein, 23 aa, Brucella spp.
RHSRSGLVGLLLPLHDNRFFSAM

SEQ ID NO: 21797 - protein, 18 aa, Brucella spp.
LHDNRFFSAMAQIFEAHV

SEQ ID NO: 21798 - protein, 21 aa, Brucella spp.
AETLISYAIDELFICGATDPD

SEQ ID NO: 21799 - protein, 20 aa, Brucella spp.
PLQPEDLCLFGGRNDESTRQ

SEQ ID NO: 21800 - protein, 20 aa, Brucella spp.
HGRLPRGLFVNSSINLEGLL

SEQ ID NO: 21801 - protein, 17 aa, Brucella spp.
LEGLLRFMAEHPGEPLN

SEQ ID NO: 21802 - protein, 28 aa, Brucella spp.
VIGCYDYDPFASFLPFPVISILQDVEGM

SEQ ID NO: 21803 - protein, 20 aa, Brucella spp.
TEMKVALPQTVTIKPRTMTY

SEQ ID NO: 21804 - protein, 22 aa, Brucella spp.
PPEDLPINRNWASADKPVVGVS

SEQ ID NO: 21805 - protein, 27 aa, Brucella spp.
SVWHLPTDEQWAFAAGTRFADDAVGIE

SEQ ID NO: 21806 - protein, 17 aa, Brucella spp.
FAAGTRFADDAVGIEGD

SEQ ID NO: 21807 - protein, 24 aa, Brucella spp.
VPPDNLGFRLVRDGRWYAPVLMRL

SEQ ID NO: 21808 - protein, 24 aa, Brucella spp.
SPHQADVYLLRGFADIFSTGIDEI

SEQ ID NO: 21809 - protein, 19 aa, Brucella spp.
GHAAWRLVLNRIVADQQKN

SEQ ID NO: 21810 - protein, 18 aa, Brucella spp.
RRGIAVDYMATFAATGPD

SEQ ID NO: 21811 - protein, 19 aa, Brucella spp.
PGNVRRVVNFYFKQHGWGL

SEQ ID NO: 21812 - protein, 21 aa, Brucella spp.
QHGWGLPLVPGPRFHGHLENR

SEQ ID NO: 21813 - protein, 24 aa, Brucella spp.
IGTLIELLFLWLFYASHKQLGKNW

SEQ ID NO: 21814 - protein, 27 aa, Brucella spp.
LLLIAPFKPVLLFAVLERKGFEAKPEP

SEQ ID NO: 21815 - protein, 29 aa, Brucella spp.
SGNECALFEMAWQRKLPLLLKGPTGCGKT

SEQ ID NO: 21816 - protein, 18 aa, Brucella spp.
CGKTRFVSHMAARMGLPL

SEQ ID NO: 21817 - protein, 20 aa, Brucella spp.
LDAPDSFMLVVSYNPGYQNL

SEQ ID NO: 21818 - protein, 18 aa, Brucella spp.
SRVAPLVDLAHRLRALKG

SEQ ID NO: 21819 - protein, 19 aa, Brucella spp.
GVSTRLLVYCAALIEAGMS

SEQ ID NO: 21820 - protein, 17 aa, Brucella spp.
LSVLLPFNIVRMIHTNA

SEQ ID NO: 21821 - protein, 22 aa, Brucella spp.
TKLAVIQFWLFFVAAGVAVAGY

SEQ ID NO: 21822 - protein, 22 aa, Brucella spp.
FLEQPFFIKVGIVVVCLIFLFN

SEQ ID NO: 21823 - protein, 20 aa, Brucella spp.
VGIVVVCLIFLFNITLTALK

SEQ ID NO: 21824 - protein, 20 aa, Brucella spp.
VCLIFLFNITLTALKGRKTT

SEQ ID NO: 21825 - protein, 25 aa, Brucella spp.
LFGLWGLALFFLFAFYNPINLALDK

SEQ ID NO: 21826 - protein, 17 aa, Brucella spp.
GVWELIMASILAFLMIK

SEQ ID NO: 21827 - protein, 20 aa, Brucella spp.
WELIMASILAFLMIKLNGID

SEQ ID NO: 21828 - protein, 20 aa, Brucella spp.
EVAPFFTMVMFTFVMTWRAG

SEQ ID NO: 21829 - protein, 17 aa, Brucella spp.
NRAALLWSIGCSVMAFF

SEQ ID NO: 21830 - protein, 21 aa, Brucella spp.
EVQDQLALFYWIRLGSGVVVV

SEQ ID NO: 21831 - protein, 22 aa, Brucella spp.
LVWSELITFAILLDAFMVMSVV

SEQ ID NO: 21832 - protein, 17 aa, Brucella spp.
LLFAALFGFCFVAVKLL

SEQ ID NO: 21833 - protein, 18 aa, Brucella spp.
ALFGFCFVAVKLLEYSHE

SEQ ID NO: 21834 - protein, 25 aa, Brucella spp.
APAIICFSLILYRMGALQGAGTISA

SEQ ID NO: 21835 - protein, 23 aa, Brucella spp.
LEETVLFPDFHRQSGSYFAGVVI

SEQ ID NO: 21836 - protein, 17 aa, Brucella spp.
FHRQSGSYFAGVVIERL

SEQ ID NO: 21837 - protein, 24 aa, Brucella spp.
LVVSLPLLFLASWLVYLAFFDRDV

SEQ ID NO: 21838 - protein, 18 aa, Brucella spp.
VAFLPFALLVIVAEALFW

SEQ ID NO: 21839 - protein, 18 aa, Brucella spp.
FLIGAGLVIFGTMTRAVA

SEQ ID NO: 21840 - protein, 23 aa, Brucella spp.
GESRDWLLGLNVVFAGLYILSLV

SEQ ID NO: 21841 - protein, 23 aa, Brucella spp.
ANPAFELGVPVLAERARSHGLAA

SEQ ID NO: 21842 - protein, 23 aa, Brucella spp.
KPLLGTNPFAFGWPRRDNPPYVF

SEQ ID NO: 21843 - protein, 24 aa, Brucella spp.
WPRRDNPPYVFDFATSVAARGEIE

SEQ ID NO: 21844 - protein, 19 aa, Brucella spp.
TSPEVLDFLGTTTLSPVHG

SEQ ID NO: 21845 - protein, 22 aa, Brucella spp.
VHGEIIIAFSPEAFAAGRPGDP

SEQ ID NO: 21846 - protein, 17 aa, Brucella spp.
GLMVIPRVLSRGSAIAA

SEQ ID NO: 21847 - protein, 25 aa, Brucella spp.
YYGFATRADLFFALRAEHPNLVGFK

SEQ ID NO: 21848 - protein, 22 aa, Brucella spp.
RAEHPNLVGFKEFGGPADMRYA

SEQ ID NO: 21849 - protein, 22 aa, Brucella spp.
VLPKEVIHLCNLSQAAALGDVD

SEQ ID NO: 21850 - protein, 18 aa, Brucella spp.
ELEQALAVLSSFDEGPDL

SEQ ID NO: 21851 - protein, 17 aa, Brucella spp.
FDEGPDLVLYFKHMMVL

SEQ ID NO: 21852 - protein, 22 aa, Brucella spp.
EGPDLVLYFKHMMVLKGDKEYT

SEQ ID NO: 21853 - protein, 17 aa, Brucella spp.
TQFRLFNTWYAEWSKLP

SEQ ID NO: 21854 - protein, 22 aa, Brucella spp.
CLILLLLFIGFTAFAIPRILVN

SEQ ID NO: 21855 - protein, 17 aa, Brucella spp.
FIGFTAFAIPRILVNRK

SEQ ID NO: 21856 - protein, 22 aa, Brucella spp.
MTGEVDILRAIVKRHPLEQTLT

SEQ ID NO: 21857 - protein, 20 aa, Brucella spp.
HPLEQTLTILCRFVEKQIPG

SEQ ID NO: 21858 - protein, 19 aa, Brucella spp.
CGAAMFLRRPVIISDIATH

SEQ ID NO: 21859 - protein, 28 aa, Brucella spp.
SFRDLALPCGLRACWSMPAINGAGKVLG

SEQ ID NO: 21860 - protein, 22 aa, Brucella spp.
LSRDGFLLLIDLDDFKPVNDTY

SEQ ID NO: 21861 - protein, 20 aa, Brucella spp.
KVGCSIGIVSTREWRSNKYI

SEQ ID NO: 21862 - protein, 23 aa, Brucella spp.
PTMRTRWSAIFYAAADFDIAPLR

SEQ ID NO: 21863 - protein, 18 aa, Brucella spp.
RAPVGVWVEVPARLMEVL

SEQ ID NO: 21864 - protein, 24 aa, Brucella spp.
WVEVPARLMEVLRLAIEIGRATGG

SEQ ID NO: 21865 - protein, 18 aa, Brucella spp.
PDGTPWAIAVEMPDYNRR

SEQ ID NO: 21866 - protein, 25 aa, Brucella spp.
KLAQSLGLDVLFLLRDGETIRPQPV

SEQ ID NO: 21867 - protein, 23 aa, Brucella spp.
ETIRPQPVGALFSGHPYPLQKLG

SEQ ID NO: 21868 - protein, 25 aa, Brucella spp.
DAVQQMAASLGWNVKRIKIDDGCYE

SEQ ID NO: 21869 - protein, 18 aa, Brucella spp.
VLDMSRVLAGPWCGQILA

SEQ ID NO: 21870 - protein, 25 aa, Brucella spp.
GPRAPEPGYDFIIQGIGGLMSITGE

SEQ ID NO: 21871 - protein, 22 aa, Brucella spp.
HRDEIIGILAAHFLTGTADEWI

SEQ ID NO: 21872 - protein, 19 aa, Brucella spp.
RGVPVGAINDIARTLDEPQ

SEQ ID NO: 21873 - protein, 24 aa, Brucella spp.
RDLFYATPARLKFMKTDRAEATAI

SEQ ID NO: 21874 - protein, 27 aa, Brucella spp.
TDVVKRIGIAFPHIRFSLAGTDRTPFE

SEQ ID NO: 21875 - protein, 18 aa, Brucella spp.
IRFSLAGTDRTPFEMPAT

SEQ ID NO: 21876 - protein, 19 aa, Brucella spp.
TLERIGQVLGREFGENALA

SEQ ID NO: 21877 - protein, 17 aa, Brucella spp.
QVLGREFGENALAIDAE

SEQ ID NO: 21878 - protein, 27 aa, Brucella spp.
AERDGVRLAGFVGIPSFNRGNALHQFA

SEQ ID NO: 21879 - protein, 17 aa, Brucella spp.
NGRPVRDKQIFGALRGA

SEQ ID NO: 21880 - protein, 21 aa, Brucella spp.
RPVRDKQIFGALRGAYSDVIA

SEQ ID NO: 21881 - protein, 24 aa, Brucella spp.
ARDRHPVAVLFLTLDPALVDVNVH

SEQ ID NO: 21882 - protein, 24 aa, Brucella spp.
DVRFRDPGLVRGLIVGAIKQALAQ

SEQ ID NO: 21883 - protein, 22 aa, Brucella spp.
HRPLDLQAAPALRENGQAVLGD

SEQ ID NO: 21884 - protein, 18 aa, Brucella spp.
AHERLVYEALKNALHARP

SEQ ID NO: 21885 - protein, 23 aa, Brucella spp.
AGHAETLARFGLGVEQFGPGAIA

SEQ ID NO: 21886 - protein, 18 aa, Brucella spp.
AMLGEMNVQQLIRDLADE

SEQ ID NO: 21887 - protein, 20 aa, Brucella spp.
PDWRALALAPAAWIYGRVSG

SEQ ID NO: 21888 - protein, 24 aa, Brucella spp.
PRVSLPVLCVGNFTVGGAGKTPTA

SEQ ID NO: 21889 - protein, 17 aa, Brucella spp.
GNGRVIPAGPLRAPLTD

SEQ ID NO: 21890 - protein, 25 aa, Brucella spp.
ATVAGRRWLAFAGIGNPDKFYESVR

SEQ ID NO: 21891 - protein, 17 aa, Brucella spp.
VETHSFADHYSFEPDDI

SEQ ID NO: 21892 - protein, 17 aa, Brucella spp.
DDIRGLVDMARRQGLGL

SEQ ID NO: 21893 - protein, 18 aa, Brucella spp.
GVPPEFLSKLAVLDVDLE

SEQ ID NO: 21894 - protein, 21 aa, Brucella spp.
ILSAYRFLGSAAYPFVGSYIA

SEQ ID NO: 21895 - protein, 20 aa, Brucella spp.
FLGSAAYPFVGSYIAYRASR

SEQ ID NO: 21896 - protein, 24 aa, Brucella spp.
SVGETIALVPLVERIVATGIHVVM

SEQ ID NO: 21897 - protein, 23 aa, Brucella spp.
CESEVWPATVLSLGSRHIPHVLV

SEQ ID NO: 21898 - protein, 21 aa, Brucella spp.
RPALAEALFENFAHVVAQSEL

SEQ ID NO: 21899 - protein, 26 aa, Brucella spp.
HQMLKMRYPRLITIIVPRHPDRAPAI

SEQ ID NO: 21900 - protein, 22 aa, Brucella spp.
IGEMGLYLQLTEIAFIGNSLTK

SEQ ID NO: 21901 - protein, 20 aa, Brucella spp.
DRNMLAGAINFLFNNPQHLR

SEQ ID NO: 21902 - protein, 18 aa, Brucella spp.
LAALEPFIQPLVLQAQLP

SEQ ID NO: 21903 - protein, 25 aa, Brucella spp.
APLFKRLGLGTVLGYLAAGITIGPV

SEQ ID NO: 21904 - protein, 26 aa, Brucella spp.
FLHFSELGVVFLLFIIGLELNPSRLW

SEQ ID NO: 21905 - protein, 25 aa, Brucella spp.
IIGLELNPSRLWSLRHSIFGLGTAQ

SEQ ID NO: 21906 - protein, 22 aa, Brucella spp.
LDTEAAIIIGFGLALSSTAFAM

SEQ ID NO: 21907 - protein, 22 aa, Brucella spp.
FQDLAIVPILAIIPALSPNEPS

SEQ ID NO: 21908 - protein, 17 aa, Brucella spp.
VMIAAALFVVLGSASLL

SEQ ID NO: 21909 - protein, 24 aa, Brucella spp.
DIEPFRGIFLGLFFVAVGLSLNLS

SEQ ID NO: 21910 - protein, 19 aa, Brucella spp.
LSVILEYWAVILAAVPIFM

SEQ ID NO: 21911 - protein, 24 aa, Brucella spp.
IFMATKIVIIYLLCRIFRSSHNDA

SEQ ID NO: 21912 - protein, 27 aa, Brucella spp.
VRIAFLLPQGGEFAFVLFSAASAAAII

SEQ ID NO: 21913 - protein, 22 aa, Brucella spp.
LRETFESGLLFGQRTLEGLGLS

SEQ ID NO: 21914 - protein, 20 aa, Brucella spp.
PRFAVAFGGGGARGIAHIHV

SEQ ID NO: 21915 - protein, 17 aa, Brucella spp.
VFLPDSFPSNVEDLKIP

SEQ ID NO: 21916 - protein, 23 aa, Brucella spp.
NVEDLKIPITITAVDFHGAREIH

SEQ ID NO: 21917 - protein, 20 aa, Brucella spp.
GLFNPVPFDLLFDKADIVIG

SEQ ID NO: 21918 - protein, 25 aa, Brucella spp.
PNVERIGLLDFLKFEQVISQSAAVR

SEQ ID NO: 21919 - protein, 21 aa, Brucella spp.
GEVPIGAVIVRDGEIIARAGN

SEQ ID NO: 21920 - protein, 24 aa, Brucella spp.
EPCAMCAAAISFARIRRLYYGASD

SEQ ID NO: 21921 - protein, 18 aa, Brucella spp.
PEIYPGFCEADARKILKD

SEQ ID NO: 21922 - protein, 23 aa, Brucella spp.
TRRYLSEPPLAYRQPASTAAVGE

SEQ ID NO: 21923 - protein, 17 aa, Brucella spp.
PMRAGLPQREPLFVQRW

SEQ ID NO: 21924 - protein, 21 aa, Brucella spp.
LPQREPLFVQRWEEMNLYKKL

SEQ ID NO: 21925 - protein, 27 aa, Brucella spp.
VPGWDCHGLPIEWKIEEKYRAAGKNKD

SEQ ID NO: 21926 - protein, 19 aa, Brucella spp.
QTEEFKRLAILGDFENPYT

SEQ ID NO: 21927 - protein, 18 aa, Brucella spp.
KRLAILGDFENPYTTMNF

SEQ ID NO: 21928 - protein, 20 aa, Brucella spp.
AEARIAGELLKFAASGQLYR

SEQ ID NO: 21929 - protein, 19 aa, Brucella spp.
ESDMIWVKFPVAGEVATEN

SEQ ID NO: 21930 - protein, 18 aa, Brucella spp.
AKAKLQFKRLRSVSAEEL

SEQ ID NO: 21931 - protein, 25 aa, Brucella spp.
LDHPLKGFGGGYEFVVPMLDGDHVT

SEQ ID NO: 21932 - protein, 24 aa, Brucella spp.
EARGIDPNIPFPVGDDGFYTKDAP

SEQ ID NO: 21933 - protein, 19 aa, Brucella spp.
GRPDWVLSRQRAWGVPICV

SEQ ID NO: 21934 - protein, 21 aa, Brucella spp.
LSRQRAWGVPICVFVDEEGNI

SEQ ID NO: 21935 - protein, 19 aa, Brucella spp.
KEGADAWFADGARERFLGA

SEQ ID NO: 21936 - protein, 21 aa, Brucella spp.
ESGADILRLWVMTTDYWEDQR

SEQ ID NO: 21937 - protein, 18 aa, Brucella spp.
LRNTIRWMLGTLAHDEGE

SEQ ID NO: 21938 - protein, 21 aa, Brucella spp.
NVELSAFYFDIRKDALYCDAP

SEQ ID NO: 21939 - protein, 24 aa, Brucella spp.
REIFVRLTTWLAPMLPFTMEEAWL

SEQ ID NO: 21940 - protein, 18 aa, Brucella spp.
FTMEEAWLDRYPQSVSIH

SEQ ID NO: 21941 - protein, 24 aa, Brucella spp.
AEKAEILRLMGFDAVMEQPFTAEF

SEQ ID NO: 21942 - protein, 17 aa, Brucella spp.
AGFSVTLVDAFTDEGGM

SEQ ID NO: 21943 - protein, 24 aa, Brucella spp.
GEVAEAAGLLGYRYRICGEVIHGK

SEQ ID NO: 21944 - protein, 19 aa, Brucella spp.
VIHGKKLGRTLGFPTANMA

SEQ ID NO: 21945 - protein, 25 aa, Brucella spp.
DDEGAPLLETFLFDFSGDLYGKTAA

SEQ ID NO: 21946 - protein, 21 aa, Brucella spp.
GKTAAVSFFGFLRGEVKFDGL

SEQ ID NO: 21947 - protein, 20 aa, Brucella spp.
RPHPGVVAQMSLLGVPEDAY

SEQ ID NO: 21948 - protein, 24 aa, Brucella spp.
MVERGPRLIWCAGALAREYGQLGG

SEQ ID NO: 21949 - protein, 17 aa, Brucella spp.
GAADFGLDVLYISGGVH

SEQ ID NO: 21950 - protein, 22 aa, Brucella spp.
IDVPADRYWGAQTQRSLQNFRI

SEQ ID NO: 21951 - protein, 22 aa, Brucella spp.
GERMPLPLVHALGVVKRAAAET

SEQ ID NO: 21952 - protein, 23 aa, Brucella spp.
GKLDDHFPLVVWQTGSGTQSNMN

SEQ ID NO: 21953 - protein, 22 aa, Brucella spp.
VKEEAFKDIIKIGRTHTQDATP

SEQ ID NO: 21954 - protein, 20 aa, Brucella spp.
VTLGQEFSGYRAALEYARHR

SEQ ID NO: 21955 - protein, 17 aa, Brucella spp.
FSGYRAALEYARHRLEQ

SEQ ID NO: 21956 - protein, 24 aa, Brucella spp.
RHRLEQSLADVFLLAQGGTAVGTG

SEQ ID NO: 21957 - protein, 19 aa, Brucella spp.
GLNAPVGFDKGFAEAVSEI

SEQ ID NO: 21958 - protein, 19 aa, Brucella spp.
FEALASHGAVLNFHGSLNA

SEQ ID NO: 21959 - protein, 26 aa, Brucella spp.
LAADLFKIANDIRFLGSGPRSGLGEL

SEQ ID NO: 21960 - protein, 28 aa, Brucella spp.
GHFELNVFKPVIAYNVLQSIRLLSDTMV

SEQ ID NO: 21961 - protein, 19 aa, Brucella spp.
KELLERSLMLVTALAPAIG

SEQ ID NO: 21962 - protein, 24 aa, Brucella spp.
SMLIQFCFFGAYFIVSLPAGQLVK

SEQ ID NO: 21963 - protein, 20 aa, Brucella spp.
RISYKCGIVVGLIVAAIGCA

SEQ ID NO: 21964 - protein, 24 aa, Brucella spp.
ADAVRFPYLLLALAFTVLAIIFAI

SEQ ID NO: 21965 - protein, 18 aa, Brucella spp.
HLVLGAIGIFVYVGAEVS

SEQ ID NO: 21966 - protein, 22 aa, Brucella spp.
NSIMFPTIFSLALHGLGSHTSQ

SEQ ID NO: 21967 - protein, 25 aa, Brucella spp.
DAIGIHLAFLMPIICYAYIAFYGLI

SEQ ID NO: 21968 - protein, 18 aa, Brucella spp.
ENTLAVLEKAGYKVVLPD

SEQ ID NO: 21969 - protein, 17 aa, Brucella spp.
DLDILFLSASEIARKLG

SEQ ID NO: 21970 - protein, 23 aa, Brucella spp.
DERVAIEAQLGFGHADVVVAVPE

SEQ ID NO: 21971 - protein, 24 aa, Brucella spp.
HADVVVAVPEVWRDVTTMADLDDV

SEQ ID NO: 21972 - protein, 20 aa, Brucella spp.
RRLRIATKYWRLTQQFFSQK

SEQ ID NO: 21973 - protein, 18 aa, Brucella spp.
RSQACLVSARRSHTSRRV

SEQ ID NO: 21974 - protein, 20 aa, Brucella spp.
LVEIPLIQPADPFLDMAGED

SEQ ID NO: 21975 - protein, 24 aa, Brucella spp.
GDSLCLRPEFTIPVCRNHIALNAA

SEQ ID NO: 21976 - protein, 19 aa, Brucella spp.
GMLKALGLPQGWRKKLLRS

SEQ ID NO: 21977 - protein, 20 aa, Brucella spp.
LGLPQGWRKKLLRSFGDAHS

SEQ ID NO: 21978 - protein, 17 aa, Brucella spp.
KKLLRSFGDAHSMDLAL

SEQ ID NO: 21979 - protein, 17 aa, Brucella spp.
EGDEIGLARMLEAEMLE

SEQ ID NO: 21980 - protein, 17 aa, Brucella spp.
DEIGLARMLEAEMLEAG

SEQ ID NO: 21981 - protein, 23 aa, Brucella spp.
FPAAALDLLRQFLAIRVSLDTAA

SEQ ID NO: 21982 - protein, 25 aa, Brucella spp.
DIIYDASFGRPLDYYTGLVYEIRDA

SEQ ID NO: 21983 - protein, 19 aa, Brucella spp.
KARLPRGFVDRVPDDLRAA

SEQ ID NO: 21984 - protein, 23 aa, Brucella spp.
ATIREVYDLYGFEPVETPLVEYT

SEQ ID NO: 21985 - protein, 21 aa, Brucella spp.
LRYDLTAPLARYVAENFETLP

SEQ ID NO: 21986 - protein, 23 aa, Brucella spp.
KPYRSYRNGWVFRNEKPGPGRFR

SEQ ID NO: 21987 - protein, 23 aa, Brucella spp.
NEKPGPGRFRQFMQFDADTVGAP

SEQ ID NO: 21988 - protein, 18 aa, Brucella spp.
NAAKRLNVLRAIDKLDKF

SEQ ID NO: 21989 - protein, 19 aa, Brucella spp.
RLNVLRAIDKLDKFGPEGV

SEQ ID NO: 21990 - protein, 21 aa, Brucella spp.
KFGPEGVRLLLGKGRLDESGD

SEQ ID NO: 21991 - protein, 23 aa, Brucella spp.
QLPEAAIEKVLAFTAAGGADGAQ

SEQ ID NO: 21992 - protein, 27 aa, Brucella spp.
EGVQELADMQALFFAGGYEGRVKIDPS

SEQ ID NO: 21993 - protein, 25 aa, Brucella spp.
VKIDPSVVRGLEYYTGPVFEAELLF

SEQ ID NO: 21994 - protein, 26 aa, Brucella spp.
LEYYTGPVFEAELLFDVTNEDGQKVV

SEQ ID NO: 21995 - protein, 28 aa, Brucella spp.
GEPVPATGFSIGVSRLMTALKNLGKLDV

SEQ ID NO: 21996 - protein, 20 aa, Brucella spp.
HDISFPTYLLRRFPGRWPPH

SEQ ID NO: 21997 - protein, 20 aa, Brucella spp.
SDFANGSIWVFARKGKALSH

SEQ ID NO: 21998 - protein, 22 aa, Brucella spp.
GNHIPQLGYGVWQISNDEAVSA

SEQ ID NO: 21999 - protein, 23 aa, Brucella spp.
IARADIFLTTKLWNSDQGYESTL

SEQ ID NO: 22000 - protein, 34 aa, Brucella spp.
LGTDYVDLYLIHWPMPSKDLFMETWRAFIKLKEE

SEQ ID NO: 22001 - protein, 19 aa, Brucella spp.
EGRVKSIGVSNFRTADLER

SEQ ID NO: 22002 - protein, 17 aa, Brucella spp.
SGVTPVLNQIELHPQFQ

SEQ ID NO: 22003 - protein, 18 aa, Brucella spp.
HAKSVAQIILRWHIETGN

SEQ ID NO: 22004 - protein, 21 aa, Brucella spp.
SVAQIILRWHIETGNIVIPKS

SEQ ID NO: 22005 - protein, 23 aa, Brucella spp.
PARIKENFDIFDFTLNGTDHDAI

SEQ ID NO: 22006 - protein, 18 aa, Brucella spp.
KTYKRPFMNRLLRSVLAQ

SEQ ID NO: 22007 - protein, 31 aa, Brucella spp.
SVLAQVLPYPARFRLALKLAKLGKPFASLFR

SEQ ID NO: 22008 - protein, 23 aa, Brucella spp.
REPKDLLVKAGFTVKEPLEGHLC

SEQ ID NO: 22009 - protein, 23 aa, Brucella spp.
SDLPIVHTVELIDWAYGGPTPQA

SEQ ID NO: 22010 - protein, 23 aa, Brucella spp.
SMPLEDAVLLVMSRFNRILEIDY

SEQ ID NO: 22011 - protein, 17 aa, Brucella spp.
LKYGLTANNVLGIEMVL

SEQ ID NO: 22012 - protein, 18 aa, Brucella spp.
KPETARAIMVGFPSSEQA

SEQ ID NO: 22013 - protein, 21 aa, Brucella spp.
YPLDVEALLIVELDGPPVEVD

SEQ ID NO: 22014 - protein, 17 aa, Brucella spp.
PPVEVDYLLGRVEKIAL

SEQ ID NO: 22015 - protein, 17 aa, Brucella spp.
VDYLLGRVEKIALQNGS

SEQ ID NO: 22016 - protein, 20 aa, Brucella spp.
EEQRLAFWAGRKAAFPAVGR

SEQ ID NO: 22017 - protein, 23 aa, Brucella spp.
TIPRKELPRVLSGMRALSEKYGL

SEQ ID NO: 22018 - protein, 19 aa, Brucella spp.
LSEKYGLRVANVFHAGDGN

SEQ ID NO: 22019 - protein, 19 aa, Brucella spp.
EAAEDFGADILRLCVKVGG

SEQ ID NO: 22020 - protein, 23 aa, Brucella spp.
IGQVFSAPVVKLFADHHKATADY

SEQ ID NO: 22021 - protein, 19 aa, Brucella spp.
AAHNIVLLHTLRSCYQLLK

SEQ ID NO: 22022 - protein, 20 aa, Brucella spp.
FPGQLEAIHALKAKDAHFAR

SEQ ID NO: 22023 - protein, 24 aa, Brucella spp.
KDEGKIDDLIAFLKQYDLGGKIKE

SEQ ID NO: 22024 - protein, 28 aa, Brucella spp.
FLPPVPLPRRMWAGGAFTFRDDIRVGDI

SEQ ID NO: 22025 - protein, 26 aa, Brucella spp.
CRFITPSAPLLFRYSALTFNGHRIHY

SEQ ID NO: 22026 - protein, 18 aa, Brucella spp.
PVRFDFRSLSPLFDDADF

SEQ ID NO: 22027 - protein, 21 aa, Brucella spp.
DDGEGLKLWTSYANGPVAMEA

SEQ ID NO: 22028 - protein, 17 aa, Brucella spp.
AEFLPVALSSFLMDNPG

SEQ ID NO: 22029 - protein, 25 aa, Brucella spp.
ASLETFPFREDYLVVVVPQGHPFAR

SEQ ID NO: 22030 - protein, 22 aa, Brucella spp.
RRIAFKDTLDYDFIGLSQGAAL

SEQ ID NO: 22031 - protein, 17 aa, Brucella spp.
MAIRIIALDDAWALRRL

SEQ ID NO: 22032 - protein, 17 aa, Brucella spp.
LDDAWALRRLTICVRSL

SEQ ID NO: 22033 - protein, 17 aa, Brucella spp.
MNIMALISILHLSSGGV

SEQ ID NO: 22034 - protein, 19 aa, Brucella spp.
IGACGCMSALARYASSVNE

SEQ ID NO: 22035 - protein, 19 aa, Brucella spp.
RESRLFLQQGLFNLKKSDT

SEQ ID NO: 22036 - protein, 22 aa, Brucella spp.
AEQSLQTAIAIRDKIVQAYLEI

SEQ ID NO: 22037 - protein, 18 aa, Brucella spp.
AGEIAREYSLNTSIVKAF

SEQ ID NO: 22038 - protein, 20 aa, Brucella spp.
EYSLNTSIVKAFHRMMLSVA

SEQ ID NO: 22039 - protein, 18 aa, Brucella spp.
QAIAESLAALKWLQKNNC

SEQ ID NO: 22040 - protein, 20 aa, Brucella spp.
ESLAALKWLQKNNCQQFFFK

SEQ ID NO: 22041 - protein, 24 aa, Brucella spp.
LQKNNCQQFFFKYCSTFDSTPKGN

SEQ ID NO: 22042 - protein, 17 aa, Brucella spp.
TVICPALPVNGRTIYNG

SEQ ID NO: 22043 - protein, 25 aa, Brucella spp.
LPVNGRTIYNGYLFVNGVLLSETGM

SEQ ID NO: 22044 - protein, 21 aa, Brucella spp.
QSEGIRYAVLDALNDQHIETL

SEQ ID NO: 22045 - protein, 23 aa, Brucella spp.
DAAYIDVLAEWVLAQSGDALPPL

SEQ ID NO: 22046 - protein, 24 aa, Brucella spp.
AKRLEAEGFTRFIVAGGETSGAVT

SEQ ID NO: 22047 - protein, 25 aa, Brucella spp.
TIGPQIAPGVPWVRGIGKPLSLALK

SEQ ID NO: 22048 - protein, 23 aa, Brucella spp.
FNEVPFLERFRLAAEAGFGGVEF

SEQ ID NO: 22049 - protein, 25 aa, Brucella spp.
GFGGVEFLFPYDFDADVIARELKQH

SEQ ID NO: 22050 - protein, 32 aa, Brucella spp.
DEGELNYPYLFSVLESVGYRGWVGCEYNPRGK

SEQ ID NO: 22051 - protein, 22 aa, Brucella spp.
LSIAELAEMLGVSPMTVRRDIH

SEQ ID NO: 22052 - protein, 17 aa, Brucella spp.
LSVAGGVQLPERIFSEP

SEQ ID NO: 22053 - protein, 26 aa, Brucella spp.
GEAIRRFNFDLAFISTSSFGARGVST

SEQ ID NO: 22054 - protein, 19 aa, Brucella spp.
RAVVESAVRRVLVTDSSKY

SEQ ID NO: 22055 - protein, 21 aa, Brucella spp.
WGLFLLLFVRLLAMIWVPLTD

SEQ ID NO: 22056 - protein, 25 aa, Brucella spp.
AGSRRWGWLFFLGLAIGLLAKGPVA

SEQ ID NO: 22057 - protein, 18 aa, Brucella spp.
AVLVIPWYAAAEIAPPGF

SEQ ID NO: 22058 - protein, 20 aa, Brucella spp.
YAAAEIAPPGFLKYFLIGEH

SEQ ID NO: 22059 - protein, 19 aa, Brucella spp.
IAPPGFLKYFLIGEHIQRF

SEQ ID NO: 22060 - protein, 21 aa, Brucella spp.
LPWSPLLPVLIWRLRKNGMPD

SEQ ID NO: 22061 - protein, 25 aa, Brucella spp.
KLGVVEVLLIFLVITIGSFFGLGRS

SEQ ID NO: 22062 - protein, 22 aa, Brucella spp.
CHCFPAIAPLVARLSYGPATWV

SEQ ID NO: 22063 - protein, 19 aa, Brucella spp.
DRYLMIAVIALAAASALLP

SEQ ID NO: 22064 - protein, 23 aa, Brucella spp.
SEQKTVRRFPSFRPSEQVAPASE

SEQ ID NO: 22065 - protein, 17 aa, Brucella spp.
RGQPFPKPVFALRDVVG

SEQ ID NO: 22066 - protein, 18 aa, Brucella spp.
VFALRDVVGGMAMIEDAS

SEQ ID NO: 22067 - protein, 23 aa, Brucella spp.
AMIEDASGYWFVEKGSLLPDGSR

SEQ ID NO: 22068 - protein, 18 aa, Brucella spp.
ITLGCMLGGFIAMGGHVS

SEQ ID NO: 22069 - protein, 28 aa, Brucella spp.
HVSVLIQPWEFIIILGAALGTFFVANPF

SEQ ID NO: 22070 - protein, 20 aa, Brucella spp.
DYLDVLGVLYSLMRELRAKS

SEQ ID NO: 22071 - protein, 22 aa, Brucella spp.
NPKESPIFLAYPSVLKKEDLTN

SEQ ID NO: 22072 - protein, 18 aa, Brucella spp.
ALPALGIVAAVLSVIKAM

SEQ ID NO: 22073 - protein, 26 aa, Brucella spp.
ASKPNLDLIMGIPVDVQVVLGGTTMP

SEQ ID NO: 22074 - protein, 20 aa, Brucella spp.
IPVDVQVVLGGTTMPVSSLM

SEQ ID NO: 22075 - protein, 17 aa, Brucella spp.
KAHHGQIANIFNQLDRS

SEQ ID NO: 22076 - protein, 17 aa, Brucella spp.
HHGQIANIFNQLDRSEM

SEQ ID NO: 22077 - protein, 20 aa, Brucella spp.
RIKAKLFTFEDIERLSQRAR

SEQ ID NO: 22078 - protein, 22 aa, Brucella spp.
AEARRIIARIAIDLSERGIITL

SEQ ID NO: 22079 - protein, 22 aa, Brucella spp.
FSREAPILAGIASFLVIAVFVA

SEQ ID NO: 22080 - protein, 17 aa, Brucella spp.
ALVPVFIIIPLAGIAAS

SEQ ID NO: 22081 - protein, 20 aa, Brucella spp.
LLAASVIVFLVFFKGNSLFT

SEQ ID NO: 22082 - protein, 19 aa, Brucella spp.
VIVFLVFFKGNSLFTDAVA

SEQ ID NO: 22083 - protein, 19 aa, Brucella spp.
GALPEFLRKNVVRLLVANV

SEQ ID NO: 22084 - protein, 17 aa, Brucella spp.
KIREIAASHSIPVFEDV

SEQ ID NO: 22085 - protein, 17 aa, Brucella spp.
REIAASHSIPVFEDVQL

SEQ ID NO: 22086 - protein, 18 aa, Brucella spp.
IAASHSIPVFEDVQLARA

SEQ ID NO: 22087 - protein, 18 aa, Brucella spp.
PVFEDVQLARALYKQVNV

SEQ ID NO: 22088 - protein, 24 aa, Brucella spp.
SADLTVLMTLPATWVARYSSKNYF

SEQ ID NO: 22089 - protein, 20 aa, Brucella spp.
PKGVAGCTVFTFEVEDEDRT

SEQ ID NO: 22090 - protein, 18 aa, Brucella spp.
RMRPRLLSLAGIIHGTVC

SEQ ID NO: 22091 - protein, 25 aa, Brucella spp.
DGEIAEILSIARWTVVTYLQNAKIK

SEQ ID NO: 22092 - protein, 25 aa, Brucella spp.
YLSHAFSWHWLFLVNVGPGILVTIA

SEQ ID NO: 22093 - protein, 28 aa, Brucella spp.
GDLSLLDKFDWWGLFGMAAFLGSLEYVL

SEQ ID NO: 22094 - protein, 18 aa, Brucella spp.
IILTVGAIVFFYRVFTAE

SEQ ID NO: 22095 - protein, 17 aa, Brucella spp.
VDFRAFRNMNFAFGSLF

SEQ ID NO: 22096 - protein, 24 aa, Brucella spp.
RNMNFAFGSLFSFVMGVGLYGLTY

SEQ ID NO: 22097 - protein, 17 aa, Brucella spp.
TYLYPLYLSMIRGYDAL

SEQ ID NO: 22098 - protein, 19 aa, Brucella spp.
PRLMMMIGFVGFAIGTWLV

SEQ ID NO: 22099 - protein, 24 aa, Brucella spp.
DFNELLMPQILRGCSLMLCMVPIN

SEQ ID NO: 22100 - protein, 23 aa, Brucella spp.
ILRGCSLMLCMVPINNLALGTLP

SEQ ID NO: 22101 - protein, 21 aa, Brucella spp.
DEPVLKAFIEKAGRLRDKIIP

SEQ ID NO: 22102 - protein, 22 aa, Brucella spp.
NIRKPRPIIFLIKAGAPVDTET

SEQ ID NO: 22103 - protein, 24 aa, Brucella spp.
EQAYERIAPILLAVAAKYQGEPCC

SEQ ID NO: 22104 - protein, 32 aa, Brucella spp.
EAASREHGWNIPLATTARIWRAGCIIRSQLLD

SEQ ID NO: 22105 - protein, 19 aa, Brucella spp.
IWRAGCIIRSQLLDDIAQA

SEQ ID NO: 22106 - protein, 24 aa, Brucella spp.
GNESRNLLMAPAFVPRMETSVKSL

SEQ ID NO: 22107 - protein, 23 aa, Brucella spp.
QGQRDFFGSHGFKRIDKEGDFHG

SEQ ID NO: 22108 - protein, 25 aa, Brucella spp.
AGIIRPGWLVMLVFLFASIFASSDP

SEQ ID NO: 22109 - protein, 22 aa, Brucella spp.
DAIEPQNSFLWRGVFSHKNIAG

SEQ ID NO: 22110 - protein, 19 aa, Brucella spp.
MAVFAFAGLYLWRRGWKTS

SEQ ID NO: 22111 - protein, 21 aa, Brucella spp.
RKLTAGLIFAIQLAFATFTFG

SEQ ID NO: 22112 - protein, 17 aa, Brucella spp.
FALEALSKRPWTGYGYE

SEQ ID NO: 22113 - protein, 17 aa, Brucella spp.
ALLCAIAVIIVMPLVHY

SEQ ID NO: 22114 - protein, 17 aa, Brucella spp.
AVIIVMPLVHYARCRPV

SEQ ID NO: 22115 - protein, 21 aa, Brucella spp.
NMLLADFFLMIVLFGTLNAMM

SEQ ID NO: 22116 - protein, 17 aa, Brucella spp.
FFLMIVLFGTLNAMMES

SEQ ID NO: 22117 - protein, 18 aa, Brucella spp.
DPVWLTLILAIFGLGMTA

SEQ ID NO: 22118 - protein, 20 aa, Brucella spp.
ERDLLPSWLHAFWDPTHLWR

SEQ ID NO: 22119 - protein, 26 aa, Brucella spp.
YMDSDMAFLRPFDCSTLWHGEKLRLF

SEQ ID NO: 22120 - protein, 18 aa, Brucella spp.
FDCSTLWHGEKLRLFVRP

SEQ ID NO: 22121 - protein, 18 aa, Brucella spp.
GDLCRVYWFSPPPTEDEF

SEQ ID NO: 22122 - protein, 22 aa, Brucella spp.
FEKALPYSRIFYAVKANPAPEI

SEQ ID NO: 22123 - protein, 21 aa, Brucella spp.
PAPEILRLLASLGSSFDTASV

SEQ ID NO: 22124 - protein, 23 aa, Brucella spp.
KERDIARAFDLGIRLYAVDCVEE

SEQ ID NO: 22125 - protein, 26 aa, Brucella spp.
DGEGAKWPLSRKFGCVPAMAKDVLRR

SEQ ID NO: 22126 - protein, 18 aa, Brucella spp.
GIILRMVNMGGGFPTRYL

SEQ ID NO: 22127 - protein, 21 aa, Brucella spp.
TAQAYGMAIFDALSRHFGNRI

SEQ ID NO: 22128 - protein, 18 aa, Brucella spp.
KTPYPLPVSLTIGDEILI

SEQ ID NO: 22129 - protein, 17 aa, Brucella spp.
AHVWRFDDVFSSTVLME

SEQ ID NO: 22130 - protein, 19 aa, Brucella spp.
FDDVFSSTVLMEFDKKGDL

SEQ ID NO: 22131 - protein, 21 aa, Brucella spp.
SIAEFKYFQSVLADGKDVKMA

SEQ ID NO: 22132 - protein, 18 aa, Brucella spp.
FTDNRLLIVFTSKPEKPL

SEQ ID NO: 22133 - protein, 17 aa, Brucella spp.
NRLLIVFTSKPEKPLKL

SEQ ID NO: 22134 - protein, 17 aa, Brucella spp.
LKLAPGHKVSFGVYDPT

SEQ ID NO: 22135 - protein, 32 aa, Brucella spp.
IRGGFAILIGLLGVFIILWAWQLPPFKHSVET

SEQ ID NO: 22136 - protein, 30 aa, Brucella spp.
YASQVLWLAITFGLFYLFLSRVVLPRIGGV

SEQ ID NO: 22137 - protein, 30 aa, Brucella spp.
DRWLMEVAGWAWRVKLSLTLSLDLMRDLRE

SEQ ID NO: 22138 - protein, 29 aa, Brucella spp.
FEMETSAALGFGFRCGFLGLLHLEIIQER

SEQ ID NO: 22139 - protein, 28 aa, Brucella spp.
ESFNMASLWKLPVIYVIENNRYAMGTAV

SEQ ID NO: 22140 - protein, 27 aa, Brucella spp.
VVAGVALPIAMFWGFAQLVKRAQEMQN

SEQ ID NO: 22141 - protein, 26 aa, Brucella spp.
MGDFGPGLYRLFDFGGTRSGNLTLGS

SEQ ID NO: 22142 - protein, 26 aa, Brucella spp.
AKTAYGICGVKVWVFKGEILEHDPMA

SEQ ID NO: 22143 - protein, 26 aa, Brucella spp.
VDDFAGRLSFFFAIGMNFFMEIAKLR

SEQ ID NO: 22144 - protein, 26 aa, Brucella spp.
EPEDLLKFGLIPEFVGRLPVIATLED

SEQ ID NO: 22145 - protein, 26 aa, Brucella spp.
PAHPFPFIPNLGFSIALQLARRADNH

SEQ ID NO: 22146 - protein, 26 aa, Brucella spp.
LLSQEWKFPLLPLFRSAFAALQEGQM

SEQ ID NO: 22147 - protein, 25 aa, Brucella spp.
RALRPDIVFGADIIAGFPTETEEMF

SEQ ID NO: 22148 - protein, 25 aa, Brucella spp.
KVASCGELSRFLLALKVALADRGSA

SEQ ID NO: 22149 - protein, 25 aa, Brucella spp.
RDIVVFPHMIVPLFVGREKSIRALE

SEQ ID NO: 22150 - protein, 25 aa, Brucella spp.
EGGDIPAGLVWRVFSPDVGPDGQLP

SEQ ID NO: 22151 - protein, 25 aa, Brucella spp.
NQVNNVLCFPYIFRGALDVGATVIN

SEQ ID NO: 22152 - protein, 25 aa, Brucella spp.
GVVKLEDAWAWGFSGVMVRGSGAAW

SEQ ID NO: 22153 - protein, 25 aa, Brucella spp.
GGRNSEFLLSFALDIDGYANIHALA

SEQ ID NO: 22154 - protein, 25 aa, Brucella spp.
LRAGMSFSVTILFPGDNYPSVDPLA

SEQ ID NO: 22155 - protein, 25 aa, Brucella spp.
YSLFAACLSIGMGLSAMSANAAQPL

SEQ ID NO: 22156 - protein, 25 aa, Brucella spp.
NGPIAVLVPPVFRDFFGAETVLSAD

SEQ ID NO: 22157 - protein, 25 aa, Brucella spp.
LGMPVNLEESYKWFALAANAGDKDA

SEQ ID NO: 22158 - protein, 25 aa, Brucella spp.
PLLQELSLPRPFRFIAPSQFKNGGT

SEQ ID NO: 22159 - protein, 25 aa, Brucella spp.
LARRALDYLVGFTLSPVLWRKLPGA

SEQ ID NO: 22160 - protein, 25 aa, Brucella spp.
VYKMAMDWKIAFPLHPEYRTLPMVW

SEQ ID NO: 22161 - protein, 24 aa, Brucella spp.
GVIALGGMFALQWGNVIPSPGARV

SEQ ID NO: 22162 - protein, 24 aa, Brucella spp.
AAMPEAIAFLEWLRDDHFIFLGLR

SEQ ID NO: 22163 - protein, 24 aa, Brucella spp.
DVKFPEGQLPLILNALEVDNQGHR

SEQ ID NO: 22164 - protein, 24 aa, Brucella spp.
YRRGYKFSTYATWWIRQAITRSIA

SEQ ID NO: 22165 - protein, 24 aa, Brucella spp.
EVSEPGLHFHWWPFETYEKAQIVE

SEQ ID NO: 22166 - protein, 24 aa, Brucella spp.
ERDVAWPVSVHMLVSLGRSALKPV

SEQ ID NO: 22167 - protein, 24 aa, Brucella spp.
VVILCLGFLMIIGFSLVAEGFGLH

SEQ ID NO: 22168 - protein, 24 aa, Brucella spp.
RNDLAEAWLVWGGYAYGAGEEGQA

SEQ ID NO: 22169 - protein, 24 aa, Brucella spp.
IGEADSLPFPVEIVDPRDIDKETG

SEQ ID NO: 22170 - protein, 24 aa, Brucella spp.
PKKMALELFKPFIYARLDAKGYSS

SEQ ID NO: 22171 - protein, 24 aa, Brucella spp.
DYFKEDAISFAWNLITREFGLPKD

SEQ ID NO: 22172 - protein, 24 aa, Brucella spp.
VKELEEFPGAVLFIDEIHTVIGAG

SEQ ID NO: 22173 - protein, 24 aa, Brucella spp.
VRNYLDWLLSIPWGKKSKVKQDLN

SEQ ID NO: 22174 - protein, 24 aa, Brucella spp.
IDFGDDIYIDMDLGAFDEGFSIDD

SEQ ID NO: 22175 - protein, 24 aa, Brucella spp.
LVTGFDILFFWVARMMMMGLHFME

SEQ ID NO: 22176 - protein, 24 aa, Brucella spp.
LREAQFPLALALGAISVWKGEAFA

SEQ ID NO: 22177 - protein, 24 aa, Brucella spp.
IRKPMHIPIAFGLIGPDGKDMQPS

SEQ ID NO: 22178 - protein, 24 aa, Brucella spp.
RERFPRPFFLFVGVLRYYKGLRTL

SEQ ID NO: 22179 - protein, 24 aa, Brucella spp.
DNPMPRWWLWTFYATIFWAIAYVI

SEQ ID NO: 22180 - protein, 24 aa, Brucella spp.
LEKNLPVMLGLIGYWHRAICGYGS

SEQ ID NO: 22181 - protein, 24 aa, Brucella spp.
VEMTERAMLLALERHGVKKLEPEG

SEQ ID NO: 22182 - protein, 24 aa, Brucella spp.
GAHIRTLLLTFFFRQMPELIERGH

SEQ ID NO: 22183 - protein, 24 aa, Brucella spp.
MPRYAELIYYGFWFSPEREMLQAA

SEQ ID NO: 22184 - protein, 24 aa, Brucella spp.
IENVKLDWSRTALFLGRLSVQSLT

SEQ ID NO: 22185 - protein, 24 aa, Brucella spp.
GCEDLDWTLSVLFDAMGAMSSKYN

SEQ ID NO: 22186 - protein, 24 aa, Brucella spp.
RNFGEIEFWFALIKIITIIGLIIT

SEQ ID NO: 22187 - protein, 24 aa, Brucella spp.
KGTPEHVINFFFYLAEEVRALLAQ

SEQ ID NO: 22188 - protein, 24 aa, Brucella spp.
QWVKEWSPTEALSIMENALTATQN

SEQ ID NO: 22189 - protein, 24 aa, Brucella spp.
AGCWPVLVQIPVFFALYKVLYVTI

SEQ ID NO: 22190 - protein, 24 aa, Brucella spp.
DAFAAWGWRIPFLVSVLLLGISVW

SEQ ID NO: 22191 - protein, 24 aa, Brucella spp.
TLQEFGIILYFPVWAVVLITCALG

SEQ ID NO: 22192 - protein, 24 aa, Brucella spp.
SAGEFTCPIVIRMPSGGGIYGGQT

SEQ ID NO: 22193 - protein, 24 aa, Brucella spp.
VPGVLPLFWAFRIMVGIGFFLILL

SEQ ID NO: 22194 - protein, 24 aa, Brucella spp.
ALFSICLILSFGLVFNAVQANAIA

SEQ ID NO: 22195 - protein, 23 aa, Brucella spp.
TAERLAKHFFDWCHARWPEISAV

SEQ ID NO: 22196 - protein, 23 aa, Brucella spp.
FEKKHGVKLGFMGFFTKAVTHAL

SEQ ID NO: 22197 - protein, 23 aa, Brucella spp.
DSCREIPFEWQILRAEVLESLGR

SEQ ID NO: 22198 - protein, 23 aa, Brucella spp.
LTRPELAVLLAYAKLSLLDDLVA

SEQ ID NO: 22199 - protein, 23 aa, Brucella spp.
EKHSGSLPLAFRKKLAAKAFSRT

SEQ ID NO: 22200 - protein, 23 aa, Brucella spp.
QIGYPLMLKASWGGGGRGMRAIR

SEQ ID NO: 22201 - protein, 23 aa, Brucella spp.
LRDRFGIPVRLNFYTVEELEYIV

SEQ ID NO: 22202 - protein, 23 aa, Brucella spp.
SRDREFLGFRGFGIVRPAEAEAD

SEQ ID NO: 22203 - protein, 23 aa, Brucella spp.
VKEAVFPFARFPGVDTLLGPEMR

SEQ ID NO: 22204 - protein, 23 aa, Brucella spp.
GRLLELFAPLYLRGVGIDINRDM

SEQ ID NO: 22205 - protein, 23 aa, Brucella spp.
FRKELSTARTFGFMKDVERLWAA

SEQ ID NO: 22206 - protein, 23 aa, Brucella spp.
TRRLCLAAGLALFAPLPANAADI

SEQ ID NO: 22207 - protein, 23 aa, Brucella spp.
LALPQPLVAAFNWPEIKTQVTVD

SEQ ID NO: 22208 - protein, 23 aa, Brucella spp.
KVVKGGRRFGFAALVVVGDQKGR

SEQ ID NO: 22209 - protein, 23 aa, Brucella spp.
NRIPTQIAFALLYFGLTLIVLLS

SEQ ID NO: 22210 - protein, 23 aa, Brucella spp.
NDFSFELLPVLGFSKKDIEAANI

SEQ ID NO: 22211 - protein, 23 aa, Brucella spp.
VDYPGEWLLDLPLLGKTYAQFSA

SEQ ID NO: 22212 - protein, 23 aa, Brucella spp.
MQSFEALVASAFQRAEGQTRVSA

SEQ ID NO: 22213 - protein, 23 aa, Brucella spp.
DSYERLITMPLAWHQKRGTSNAL

SEQ ID NO: 22214 - protein, 23 aa, Brucella spp.
ENAQFPVLNWWALASGLNRMAST

SEQ ID NO: 22215 - protein, 23 aa, Brucella spp.
NDAEIPELIRWAHGRGMDVTLIE

SEQ ID NO: 22216 - protein, 23 aa, Brucella spp.
VKAKEGALLPTIGLTASASQLDT

SEQ ID NO: 22217 - protein, 23 aa, Brucella spp.
DVADGAREWVLKNLFGGTLQDSR

SEQ ID NO: 22218 - protein, 23 aa, Brucella spp.
RIFGEVPIFGALLGNGRDRGLLG

SEQ ID NO: 22219 - protein, 23 aa, Brucella spp.
SGEDYRPAVSFAAYTDMQAPARM

SEQ ID NO: 22220 - protein, 23 aa, Brucella spp.
AQAIFRKWGLDFAIVGKTTDDLR

SEQ ID NO: 22221 - protein, 23 aa, Brucella spp.
GQRELGLVFGLIFILAGLVFKIS

SEQ ID NO: 22222 - protein, 23 aa, Brucella spp.
IQRELGITRGFAFDLQAVCSGFI

SEQ ID NO: 22223 - protein, 23 aa, Brucella spp.
LADPVPLHFVYISAWSTGDGVVQ

SEQ ID NO: 22224 - protein, 23 aa, Brucella spp.
TAGLELRWPILFSTTSSTHILEP

SEQ ID NO: 22225 - protein, 23 aa, Brucella spp.
PDRIAMLVRWGFVPAWVKDPNDW

SEQ ID NO: 22226 - protein, 23 aa, Brucella spp.
LKDANALGGLKWVQKGGGYYSLC

SEQ ID NO: 22227 - protein, 23 aa, Brucella spp.
GYLEIAIRYGFLGLLFYGVLTVW

SEQ ID NO: 22228 - protein, 23 aa, Brucella spp.
LAIPVFIRFGLYRAIIRYLAERA

SEQ ID NO: 22229 - protein, 23 aa, Brucella spp.
ARRRLVGPFIFFDRMGPAILRDG

SEQ ID NO: 22230 - protein, 23 aa, Brucella spp.
GIPEDRVFGFWDWVGGRYSVWSA

SEQ ID NO: 22231 - protein, 23 aa, Brucella spp.
RAKAINFGIIYGISAFGLANQLS

SEQ ID NO: 22232 - protein, 23 aa, Brucella spp.
EGMPRIFALAWLYVAHTDSNFSL

SEQ ID NO: 22233 - protein, 23 aa, Brucella spp.
GKGESVWLGWFLAYTLKAFIPLA

SEQ ID NO: 22234 - protein, 23 aa, Brucella spp.
GSIIPWEMTWSLYLEELGPSEAT

SEQ ID NO: 22235 - protein, 23 aa, Brucella spp.
EEPPPHVKFIFATTEIRKVPITV

SEQ ID NO: 22236 - protein, 23 aa, Brucella spp.
RAYSPRFLWTWPNSRIAVMGGEQ

SEQ ID NO: 22237 - protein, 23 aa, Brucella spp.
GREWGLGELLFRLARIPGIAHLR

SEQ ID NO: 22238 - protein, 23 aa, Brucella spp.
SGEYPVSRPLYFYVKKAHLGVIP

SEQ ID NO: 22239 - protein, 23 aa, Brucella spp.
YDPEVYQGFAWGMGIGRIAMLKY

SEQ ID NO: 22240 - protein, 23 aa, Brucella spp.
AGTEFFIKADLAFIAIGFAGPVE

SEQ ID NO: 22241 - protein, 23 aa, Brucella spp.
KAIPEEILLAIGPAKGIGRDRWL

SEQ ID NO: 22242 - protein, 23 aa, Brucella spp.
DYNMKVGATLAWAGRISDEAATA

SEQ ID NO: 22243 - protein, 23 aa, Brucella spp.
SLPLIEPSFMFGLSGDELLALRD

SEQ ID NO: 22244 - protein, 23 aa, Brucella spp.
QLFEVPPSWRFTLYLCIGWPCTE

SEQ ID NO: 22245 - protein, 23 aa, Brucella spp.
KQFDLLIDWGWFYFITKPMFYLI

SEQ ID NO: 22246 - protein, 23 aa, Brucella spp.
LGLVEVLYGYPLDGVVLTIGCDK

SEQ ID NO: 22247 - protein, 23 aa, Brucella spp.
ASNEAAFLYQLFVRAYGTNNFPD

SEQ ID NO: 22248 - protein, 23 aa, Brucella spp.
SLAMCLRYSFGLVAEADRLEAAI

SEQ ID NO: 22249 - protein, 23 aa, Brucella spp.
ELNEAFAAVVLRYMQAFDIPHDK

SEQ ID NO: 22250 - protein, 23 aa, Brucella spp.
ELKERFLVTIALEAARVMEEGIV

SEQ ID NO: 22251 - protein, 23 aa, Brucella spp.
YGKRCPLVLDFIIDLARRTKRRV

SEQ ID NO: 22252 - protein, 23 aa, Brucella spp.
DERIELLALMWVGRGDFSATEWE

SEQ ID NO: 22253 - protein, 23 aa, Brucella spp.
ERTEIKPGDILRIELDMSKLGGS

SEQ ID NO: 22254 - protein, 23 aa, Brucella spp.
AKSYEFPPLWGPDSFNDGAGMNR

SEQ ID NO: 22255 - protein, 23 aa, Brucella spp.
ALRPEDIALLAQWGKSDRLDAIV

SEQ ID NO: 22256 - protein, 23 aa, Brucella spp.
DVLEILSIPLLGIIPESQDVLRA

SEQ ID NO: 22257 - protein, 23 aa, Brucella spp.
KQRGELVSCFLLRVEDNMESIGR

SEQ ID NO: 22258 - protein, 23 aa, Brucella spp.
CYDYDPFASFLPFPVISILQDVE

SEQ ID NO: 22259 - protein, 23 aa, Brucella spp.
EAIPGVGFSIWLDRLQALAGEKQ

SEQ ID NO: 22260 - protein, 22 aa, Brucella spp.
APAEAGQVLELWRDWIEQKASA

SEQ ID NO: 22261 - protein, 22 aa, Brucella spp.
IAPDMATMLSFVVTDAPIKADA

SEQ ID NO: 22262 - protein, 22 aa, Brucella spp.
RLEFPYADLVTIAYVLDELAPD

SEQ ID NO: 22263 - protein, 22 aa, Brucella spp.
GLENAFAFPGFVPAYIRPLFCR

SEQ ID NO: 22264 - protein, 22 aa, Brucella spp.
WKSCASIGLPARFNISEDGRYR

SEQ ID NO: 22265 - protein, 22 aa, Brucella spp.
KRLKSGAGFVWIKRGLTPKQQS

SEQ ID NO: 22266 - protein, 22 aa, Brucella spp.
NAFEYGYLFKMIGYGYRHKYLI

SEQ ID NO: 22267 - protein, 22 aa, Brucella spp.
HGEWPTSFGLTAWGTSNMRTGG

SEQ ID NO: 22268 - protein, 22 aa, Brucella spp.
ADYELLELLLFRAIRRADTKPI

SEQ ID NO: 22269 - protein, 22 aa, Brucella spp.
EGVEIKEGMIFTIEPMINLGKP

SEQ ID NO: 22270 - protein, 22 aa, Brucella spp.
PKDEQALVSGINIVKRHQRQTQ

SEQ ID NO: 22271 - protein, 22 aa, Brucella spp.
AEPLERGFGLTLGNALRRVLLS

SEQ ID NO: 22272 - protein, 22 aa, Brucella spp.
HTFFEMLGNFSFGDYFKEDAIS

SEQ ID NO: 22273 - protein, 22 aa, Brucella spp.
IGAEAVLARTLRAFTDCPLIGT

SEQ ID NO: 22274 - protein, 22 aa, Brucella spp.
RRWPAVDVAPLIRLIDDPRHTL

SEQ ID NO: 22275 - protein, 22 aa, Brucella spp.
PVRGEFAVWFALATKIAVGLLF

SEQ ID NO: 22276 - protein, 22 aa, Brucella spp.
PHLLEEAFSWHLRRQENGSMRK

SEQ ID NO: 22277 - protein, 22 aa, Brucella spp.
RLAGTWTYWGWKGGYFDSEEDA

SEQ ID NO: 22278 - protein, 22 aa, Brucella spp.
TEHSSKLYWTTTAISVAWAAGG

SEQ ID NO: 22279 - protein, 22 aa, Brucella spp.
QYAEKASIFWFAKHIGFEVVNI

SEQ ID NO: 22280 - protein, 22 aa, Brucella spp.
QYPMEIPGVATMEFLKVAMNSQ

SEQ ID NO: 22281 - protein, 22 aa, Brucella spp.
RRHTSFASIWVYPVIDDNIEVQ

SEQ ID NO: 22282 - protein, 22 aa, Brucella spp.
RLRDLAGLIVVDFIDMEEKRNN

SEQ ID NO: 22283 - protein, 22 aa, Brucella spp.
LFGEWHLIFMFMAIMALVVGLW

SEQ ID NO: 22284 - protein, 22 aa, Brucella spp.
DKFEFPVLIVIATLGMLLMVSA

SEQ ID NO: 22285 - protein, 22 aa, Brucella spp.
LLKEFASAFALSMRQFFAPKAT

SEQ ID NO: 22286 - protein, 22 aa, Brucella spp.
EKRLEILGGFLIAYLNLDEVIR

SEQ ID NO: 22287 - protein, 22 aa, Brucella spp.
GEIPEALRIFVAMELGVSENRI

SEQ ID NO: 22288 - protein, 22 aa, Brucella spp.
RFELFGMPLAYLPAFEMADPTV

SEQ ID NO: 22289 - protein, 22 aa, Brucella spp.
RESSTPIPIHFAFKEGAHVEAS

SEQ ID NO: 22290 - protein, 22 aa, Brucella spp.
RGWDVLAPIYLRLGRASDAVSA

SEQ ID NO: 22291 - protein, 22 aa, Brucella spp.
RLEEVAYSFAFALKVVGKVPSF

SEQ ID NO: 22292 - protein, 22 aa, Brucella spp.
KQLEYSWVLSLMGAYSDFWKLT

SEQ ID NO: 22293 - protein, 22 aa, Brucella spp.
TAEKAVGMILAFLQKEGPADKV

SEQ ID NO: 22294 - protein, 22 aa, Brucella spp.
ISHVAPVSILLFGKPVGDVVKI

SEQ ID NO: 22295 - protein, 22 aa, Brucella spp.
VAREMLAAGGFYWNSGMFLFRS

SEQ ID NO: 22296 - protein, 22 aa, Brucella spp.
GEVFPPDRLLAFRPGDDIVVQA

SEQ ID NO: 22297 - protein, 22 aa, Brucella spp.
IWPQEFYYVAGLLIMAGLGLFL

SEQ ID NO: 22298 - protein, 22 aa, Brucella spp.
AFDIPVCPHFLMELHVSLVCAV

SEQ ID NO: 22299 - protein, 22 aa, Brucella spp.
GRLPTQIGLRFFVDAFLEVGDL

SEQ ID NO: 22300 - protein, 22 aa, Brucella spp.
VVEYTLYMLWDMGLKVGHSTRN

SEQ ID NO: 22301 - protein, 22 aa, Brucella spp.
GEDIPLPGYLAFPFDQRLSENG

SEQ ID NO: 22302 - protein, 22 aa, Brucella spp.
RKYDVPLYPFFLDGVATRKGLL

SEQ ID NO: 22303 - protein, 22 aa, Brucella spp.
SPALAFEIFGIHLWGKDKKQDP

SEQ ID NO: 22304 - protein, 22 aa, Brucella spp.
KNKTEFGLFIGLDGDVDGMVHL

SEQ ID NO: 22305 - protein, 22 aa, Brucella spp.
VKEAGPAMPVEILGLQGTPQAG

SEQ ID NO: 22306 - protein, 22 aa, Brucella spp.
GLPEDILSRLFKLAGQKGTKDG

SEQ ID NO: 22307 - protein, 22 aa, Brucella spp.
VLPDCPPPFFILAHSAGALVAL

SEQ ID NO: 22308 - protein, 22 aa, Brucella spp.
EDEGLTLWLPFMSRWGSVGAHM

SEQ ID NO: 22309 - protein, 22 aa, Brucella spp.
RGSRLPFGFKGLGRVAAFVATG

SEQ ID NO: 22310 - protein, 22 aa, Brucella spp.
LIEEGFPIVSFLPRDEAFDTNI

SEQ ID NO: 22311 - protein, 22 aa, Brucella spp.
GNMGFAMLRGWLDSGILKAGDV

SEQ ID NO: 22312 - protein, 22 aa, Brucella spp.
NWALDVPMYFILRDGHYHDCTH

SEQ ID NO: 22313 - protein, 22 aa, Brucella spp.
RRICALPAYWVGLLYDEEALAA

SEQ ID NO: 22314 - protein, 22 aa, Brucella spp.
AGWNMPTTYPLGVMKEHLHTRD

SEQ ID NO: 22315 - protein, 22 aa, Brucella spp.
QRDMPALLGLVMREAGKSMPNA

SEQ ID NO: 22316 - protein, 22 aa, Brucella spp.
EDRPALAVRMIFSADGRKKSHK

SEQ ID NO: 22317 - protein, 22 aa, Brucella spp.
ARLYELIWKRAIASQMQAADIE

SEQ ID NO: 22318 - protein, 22 aa, Brucella spp.
ETEEDFQMLLDWLDEAKIERAG

SEQ ID NO: 22319 - protein, 22 aa, Brucella spp.
EEARKLGGPYVFRMNLNQQSSG

SEQ ID NO: 22320 - protein, 22 aa, Brucella spp.
VEVAIKMALGYFYNRGEPRSRI

SEQ ID NO: 22321 - protein, 22 aa, Brucella spp.
AFGPRWGFLAIFLVWVESTIWF

SEQ ID NO: 22322 - protein, 22 aa, Brucella spp.
AKELPDYLPLFLEFLSTRSTEE

SEQ ID NO: 22323 - protein, 22 aa, Brucella spp.
WPGEPAPLITWPLVITRAPDDP

SEQ ID NO: 22324 - protein, 22 aa, Brucella spp.
GSLPVIIGLLIIWTVFQTLNPV

SEQ ID NO: 22325 - protein, 22 aa, Brucella spp.
GTLIELLFLWLFYASHKQLGKN

SEQ ID NO: 22326 - protein, 22 aa, Brucella spp.
AVQQMAASLGWNVKRIKIDDGC

SEQ ID NO: 22327 - protein, 22 aa, Brucella spp.
HFSELGVVFLLFIIGLELNPSR

SEQ ID NO: 22328 - protein, 22 aa, Brucella spp.
VLPYPARFRLALKLAKLGKPFA

SEQ ID NO: 22329 - protein, 21 aa, Brucella spp.
EVAPEPKLSWFERLRRGLARS

SEQ ID NO: 22330 - protein, 21 aa, Brucella spp.
ERFLSQPFFVAEVFTGSPGKL

SEQ ID NO: 22331 - protein, 21 aa, Brucella spp.
EIGDLRLTVMAGIMVMDELAE

SEQ ID NO: 22332 - protein, 21 aa, Brucella spp.
HDAPPARFIWKVGPDGTFSEI

SEQ ID NO: 22333 - protein, 21 aa, Brucella spp.
DLNVIELLFFSYRDFTADPDL

SEQ ID NO: 22334 - protein, 21 aa, Brucella spp.
ADLGFPLVVRPSYVLGGRAMQ

SEQ ID NO: 22335 - protein, 21 aa, Brucella spp.
QLHSWGWRIPFAIGGLAAIVA

SEQ ID NO: 22336 - protein, 21 aa, Brucella spp.
FVENVPFYGFGVMCLDHPEVQ

SEQ ID NO: 22337 - protein, 21 aa, Brucella spp.
IGAAVLGFWLFQSVYTVQPDE

SEQ ID NO: 22338 - protein, 21 aa, Brucella spp.
RVSRALPIILGFLVIDMLFFS

SEQ ID NO: 22339 - protein, 21 aa, Brucella spp.
FKLESFLAAAFFALAAALVLQ

SEQ ID NO: 22340 - protein, 21 aa, Brucella spp.
ESLPFAIEPAYGWKRKATVAH

SEQ ID NO: 22341 - protein, 21 aa, Brucella spp.
HLCAAGVVFLALVQVAKILRA

SEQ ID NO: 22342 - protein, 21 aa, Brucella spp.
HIKWFDVAKGYGFIVPDQPGL

SEQ ID NO: 22343 - protein, 21 aa, Brucella spp.
TEYPRSQWWQFAVEDEKLQGE

SEQ ID NO: 22344 - protein, 21 aa, Brucella spp.
LAAPVAHIWFLKSLPSRIGTL

SEQ ID NO: 22345 - protein, 21 aa, Brucella spp.
GAKEPLMWRLLPALIREMGQA

SEQ ID NO: 22346 - protein, 21 aa, Brucella spp.
IHLAFVLGLVFLVFPFSRKGY

SEQ ID NO: 22347 - protein, 21 aa, Brucella spp.
IRFPVTDVRVFAGRNSIGVRG

SEQ ID NO: 22348 - protein, 21 aa, Brucella spp.
IPDAEALDILFALVEEEGLCL

SEQ ID NO: 22349 - protein, 21 aa, Brucella spp.
ELGGYISFSGILTFKNSADIR

SEQ ID NO: 22350 - protein, 21 aa, Brucella spp.
KTQIDLPWLGWRKGAGIPAKA

SEQ ID NO: 22351 - protein, 21 aa, Brucella spp.
DGRGFPYFWLHFGRGKAPVAD

SEQ ID NO: 22352 - protein, 21 aa, Brucella spp.
IKPEFLALFLALSFYTASFIA

SEQ ID NO: 22353 - protein, 21 aa, Brucella spp.
MTCIQVFFFRTGQNWGNRAYF

SEQ ID NO: 22354 - protein, 21 aa, Brucella spp.
DPNDWPLMFNIRSETAAEKNS

SEQ ID NO: 22355 - protein, 21 aa, Brucella spp.
EVYVWPYFYAMPLDKLTPPQI

SEQ ID NO: 22356 - protein, 21 aa, Brucella spp.
FAEWKRAVSLNVTLFAGTIGV

SEQ ID NO: 22357 - protein, 21 aa, Brucella spp.
EPVEISAPLLLRSPLLRPSDL

SEQ ID NO: 22358 - protein, 21 aa, Brucella spp.
NLPECVRNNFLLVVAGGKGWN

SEQ ID NO: 22359 - protein, 21 aa, Brucella spp.
YEALKLIDWPEGFYRSDIGWR

SEQ ID NO: 22360 - protein, 21 aa, Brucella spp.
LPLEVAPLFKDWLLRNYPDRY

SEQ ID NO: 22361 - protein, 21 aa, Brucella spp.
GEPPLPLGLSVLHALADAVAS

SEQ ID NO: 22362 - protein, 21 aa, Brucella spp.
PEENRYVWGYRVTIVNNSSET

SEQ ID NO: 22363 - protein, 21 aa, Brucella spp.
CPTGIDIPLFIRQINAGNPAG

SEQ ID NO: 22364 - protein, 21 aa, Brucella spp.
LEERMPVLWTRGVRTGRLTPN

SEQ ID NO: 22365 - protein, 21 aa, Brucella spp.
IYPEYTGNAAFFFNKADDPLW

SEQ ID NO: 22366 - protein, 21 aa, Brucella spp.
RKEELATLFTLRQQLTKRDGR

SEQ ID NO: 22367 - protein, 21 aa, Brucella spp.
RGVFELRYFFTASLASSEGGE

SEQ ID NO: 22368 - protein, 21 aa, Brucella spp.
KAAEAWRLFSLISPVSHGRNP

SEQ ID NO: 22369 - protein, 21 aa, Brucella spp.
PRDPVHVVLFYFRDSATIPIT

SEQ ID NO: 22370 - protein, 21 aa, Brucella spp.
GEYFLPIHFQLMVLPGVRREE

SEQ ID NO: 22371 - protein, 21 aa, Brucella spp.
GPEIPSFTLFSGEEMDLAFGG

SEQ ID NO: 22372 - protein, 21 aa, Brucella spp.
PDMALSGDFIVGFPGETDQDF

SEQ ID NO: 22373 - protein, 21 aa, Brucella spp.
SDGVLSFSWRIGMAPPPVINY

SEQ ID NO: 22374 - protein, 21 aa, Brucella spp.
LYLEGLAPWLIFTGRSGRGTD

SEQ ID NO: 22375 - protein, 21 aa, Brucella spp.
STDLPICVGFGVKTPEQAAAI

SEQ ID NO: 22376 - protein, 21 aa, Brucella spp.
WSRLIWYPILYGIVLNTRPRR

SEQ ID NO: 22377 - protein, 21 aa, Brucella spp.
FGNDISKLWPISYEGQSDTAC

SEQ ID NO: 22378 - protein, 21 aa, Brucella spp.
NIAEFYIVFFALMKAGIAPVN

SEQ ID NO: 22379 - protein, 21 aa, Brucella spp.
AKWPSLYAFLQWRTEPVTSLI

SEQ ID NO: 22380 - protein, 21 aa, Brucella spp.
LPEEAGAAFWPATRTLFAQAL

SEQ ID NO: 22381 - protein, 21 aa, Brucella spp.
YGEEIPLLVNLQPAGEYLGED

SEQ ID NO: 22382 - protein, 21 aa, Brucella spp.
ITIREITNFMLLRGNIGKPGA

SEQ ID NO: 22383 - protein, 21 aa, Brucella spp.
LDRPEIIRWFQIIGYHENGNE

SEQ ID NO: 22384 - protein, 21 aa, Brucella spp.
EENWKGSIPWVCPKDIKGPSI

SEQ ID NO: 22385 - protein, 21 aa, Brucella spp.
READVGSILAFGFAPYTGGTL

SEQ ID NO: 22386 - protein, 21 aa, Brucella spp.
DEVEAAWRWIDPILQAWEFNS

SEQ ID NO: 22387 - protein, 21 aa, Brucella spp.
EELLIGIPLEWRADWEPTAEA

SEQ ID NO: 22388 - protein, 21 aa, Brucella spp.
AHFSAPRMIYFGSGYMANLAA

SEQ ID NO: 22389 - protein, 21 aa, Brucella spp.
YEFRPGMVALELMALGGGAGK

SEQ ID NO: 22390 - protein, 21 aa, Brucella spp.
VLEQFPWQWLFPGGALVLAVL

SEQ ID NO: 22391 - protein, 21 aa, Brucella spp.
WEFFLTSPLIFILWGATAAGL

SEQ ID NO: 22392 - protein, 21 aa, Brucella spp.
EGAKWPLSRKFGCVPAMAKDV

SEQ ID NO: 22393 - protein, 20 aa, Brucella spp.
SERLLSFGFTLGRLKTGTPP

SEQ ID NO: 22394 - protein, 20 aa, Brucella spp.
NDVGFAFRLTFLNKCDELER

SEQ ID NO: 22395 - protein, 20 aa, Brucella spp.
IETGQRFNIGERWSVTPQAQ

SEQ ID NO: 22396 - protein, 20 aa, Brucella spp.
FSILPSVSFPVITRNPSPAL

SEQ ID NO: 22397 - protein, 20 aa, Brucella spp.
TGPAEWEFSGTFDPATGEWS

SEQ ID NO: 22398 - protein, 20 aa, Brucella spp.
EECKIGIMPGNIFKKGSVGV

SEQ ID NO: 22399 - protein, 20 aa, Brucella spp.
EGLHKIFIEAGFDWREPGCS

SEQ ID NO: 22400 - protein, 20 aa, Brucella spp.
SEIKISILIDGPYAELAVRT

SEQ ID NO: 22401 - protein, 20 aa, Brucella spp.
EVNIKIALAAAMRSGKLKRP

SEQ ID NO: 22402 - protein, 20 aa, Brucella spp.
ELNDLKFAFRVGKHVKSNAI

SEQ ID NO: 22403 - protein, 20 aa, Brucella spp.
DNTIPVIFITAFPERLLTGE

SEQ ID NO: 22404 - protein, 20 aa, Brucella spp.
AMGYKFQFITLAGFHQLNYG

SEQ ID NO: 22405 - protein, 20 aa, Brucella spp.
LEPKAIIPVDLFGLAASYNR

SEQ ID NO: 22406 - protein, 20 aa, Brucella spp.
ERGFPQFIFDIFTQYAEGGP

SEQ ID NO: 22407 - protein, 20 aa, Brucella spp.
RRITAVLPYFGYARQDRKPG

SEQ ID NO: 22408 - protein, 20 aa, Brucella spp.
VVGLPAIIRPSFTLGGTGGG

SEQ ID NO: 22409 - protein, 20 aa, Brucella spp.
VMGLDYDYALAFAKAQLGAG

SEQ ID NO: 22410 - protein, 20 aa, Brucella spp.
ESPLSFQAIIIWRDQLNESN

SEQ ID NO: 22411 - protein, 20 aa, Brucella spp.
WMAIACFAGIYGVMAGKLVY

SEQ ID NO: 22412 - protein, 20 aa, Brucella spp.
IRLHWEIKRLGLFREGEQIE

SEQ ID NO: 22413 - protein, 20 aa, Brucella spp.
PIYFLIGAAVLGFWLFQSVY

SEQ ID NO: 22414 - protein, 20 aa, Brucella spp.
GETYWPYGLEALHACAITHG

SEQ ID NO: 22415 - protein, 20 aa, Brucella spp.
EAAPLVVLKSFGKFFGLAGI

SEQ ID NO: 22416 - protein, 20 aa, Brucella spp.
MDVDLKVDLRTAVCHLNSSG

SEQ ID NO: 22417 - protein, 20 aa, Brucella spp.
PLNAFHLGYLIGPRINAGGR

SEQ ID NO: 22418 - protein, 20 aa, Brucella spp.
IQDFSGASMLEFVRYEFDPP

SEQ ID NO: 22419 - protein, 20 aa, Brucella spp.
PERDGLFCARIFGPIKDYEC

SEQ ID NO: 22420 - protein, 20 aa, Brucella spp.
ERRQALAIRWLINAARGRNE

SEQ ID NO: 22421 - protein, 20 aa, Brucella spp.
LKYYEGVPVIREITRVSKPG

SEQ ID NO: 22422 - protein, 20 aa, Brucella spp.
EVLASMGLHLGMEIPAWPPE

SEQ ID NO: 22423 - protein, 20 aa, Brucella spp.
SKDQVWPVTIAYFDDKEQQD

SEQ ID NO: 22424 - protein, 20 aa, Brucella spp.
RASVGVSLMWASPFGPLRFD

SEQ ID NO: 22425 - protein, 20 aa, Brucella spp.
PDGERWGGIPARPIKQWFRD

SEQ ID NO: 22426 - protein, 20 aa, Brucella spp.
RNCGVALDFWKIAMRPGKPL

SEQ ID NO: 22427 - protein, 20 aa, Brucella spp.
TASFSFAILIGITPITPDRT

SEQ ID NO: 22428 - protein, 20 aa, Brucella spp.
EDIPSLVEFFMKQIAEQAGI

SEQ ID NO: 22429 - protein, 20 aa, Brucella spp.
GVVEHGLFIELARAAIIAGT

SEQ ID NO: 22430 - protein, 20 aa, Brucella spp.
FEGGFPFTFSEAYSVGTPSI

SEQ ID NO: 22431 - protein, 20 aa, Brucella spp.
HALLSICILLVLLGGVGFVI

SEQ ID NO: 22432 - protein, 20 aa, Brucella spp.
LPEARGGGFWKSLPYDEKGY

SEQ ID NO: 22433 - protein, 20 aa, Brucella spp.
DPLMELSRIMDFDTPADDNV

SEQ ID NO: 22434 - protein, 20 aa, Brucella spp.
LKHDGWAALWSRDGSAGGGM

SEQ ID NO: 22435 - protein, 20 aa, Brucella spp.
PTFTELGIFSAMWNEHCSYK

SEQ ID NO: 22436 - protein, 20 aa, Brucella spp.
PHACYLGAYVLQCRDCLREI

SEQ ID NO: 22437 - protein, 20 aa, Brucella spp.
RKRPEVILKLALSADGMIGR

SEQ ID NO: 22438 - protein, 20 aa, Brucella spp.
ERWPLNGLTIIHRYGLIKPG

SEQ ID NO: 22439 - protein, 20 aa, Brucella spp.
PEFFKVESFRCLVERRFDAN

SEQ ID NO: 22440 - protein, 20 aa, Brucella spp.
ICSYLPFLGLLTIFLPKLER

SEQ ID NO: 22441 - protein, 20 aa, Brucella spp.
SEYAGLPVWTLKPGVPRNEV

SEQ ID NO: 22442 - protein, 20 aa, Brucella spp.
EGIYLFPLFYPTLGFALLLF

SEQ ID NO: 22443 - protein, 20 aa, Brucella spp.
PDGDWRVWLIMGGRGSGKTR

SEQ ID NO: 22444 - protein, 20 aa, Brucella spp.
GSVPELGFGFAMKCDDGATR

SEQ ID NO: 22445 - protein, 20 aa, Brucella spp.
LELSAGLIFPSHLRSEAFGL

SEQ ID NO: 22446 - protein, 20 aa, Brucella spp.
PDKQNVQIFIGFDEGTYNTK

SEQ ID NO: 22447 - protein, 20 aa, Brucella spp.
IAGGLAFYWNSLTRTADAPK

SEQ ID NO: 22448 - protein, 20 aa, Brucella spp.
ADLFCGVGTFALRIAEKSAV

SEQ ID NO: 22449 - protein, 20 aa, Brucella spp.
GAICALLVKPLFEAGREAIG

SEQ ID NO: 22450 - protein, 20 aa, Brucella spp.
EHALAWKLAASPLLEKLYCA

SEQ ID NO: 22451 - protein, 20 aa, Brucella spp.
LPGQAALHFLIPMLKQAAEE

SEQ ID NO: 22452 - protein, 20 aa, Brucella spp.
EHGMIPPLEFISVAEETGLI

SEQ ID NO: 22453 - protein, 20 aa, Brucella spp.
GLRPAWLLRLGLFLYDHLGG

SEQ ID NO: 22454 - protein, 20 aa, Brucella spp.
LLADFPAFFRVSGEVVAVVG

SEQ ID NO: 22455 - protein, 20 aa, Brucella spp.
EGTLVWPPRGNIGFGYDPVF

SEQ ID NO: 22456 - protein, 20 aa, Brucella spp.
MELSMPFIVRTVIAPGFTDD

SEQ ID NO: 22457 - protein, 20 aa, Brucella spp.
LKIGELWALPSAVRYFLIEN

SEQ ID NO: 22458 - protein, 20 aa, Brucella spp.
RGDWQLLPWLFSTGRGVSAI

SEQ ID NO: 22459 - protein, 20 aa, Brucella spp.
GDVKGARILGLFGDKITTDH

SEQ ID NO: 22460 - protein, 20 aa, Brucella spp.
GAPARFAVLVYLIQIMVIGL

SEQ ID NO: 22461 - protein, 20 aa, Brucella spp.
MRISQLWHWLYVRGVSDFAD

SEQ ID NO: 22462 - protein, 20 aa, Brucella spp.
PDIKIIAPWRDWSFKSRTQL

SEQ ID NO: 22463 - protein, 20 aa, Brucella spp.
VALDWKWLFIYPDQGIATVN

SEQ ID NO: 22464 - protein, 20 aa, Brucella spp.
EPLVGRLLLYNALNVRFETI

SEQ ID NO: 22465 - protein, 20 aa, Brucella spp.
QWAHFDIFGWVPVEKPASPV

SEQ ID NO: 22466 - protein, 20 aa, Brucella spp.
GNGISFDWNLLAALDADIDY

SEQ ID NO: 22467 - protein, 20 aa, Brucella spp.
FEILTAVAFVLFSEHPADAV

SEQ ID NO: 22468 - protein, 20 aa, Brucella spp.
LRTFAGIALAFFLASQSAHA

SEQ ID NO: 22469 - protein, 20 aa, Brucella spp.
PDMDGLTVLSRMRAAGVAVP

SEQ ID NO: 22470 - protein, 20 aa, Brucella spp.
DIGWPDLLVLLSGLYLSRML

SEQ ID NO: 22471 - protein, 20 aa, Brucella spp.
EFTCNVPLIIRWPGQAPGVN

SEQ ID NO: 22472 - protein, 20 aa, Brucella spp.
LFGMGCFWGAERLFWQVPGV

SEQ ID NO: 22473 - protein, 20 aa, Brucella spp.
RFLAEILYGFITRDYMRVAE

SEQ ID NO: 22474 - protein, 20 aa, Brucella spp.
RDFISLVGLVGMMFYMDPVL

SEQ ID NO: 22475 - protein, 20 aa, Brucella spp.
PGRFDVATLFAFVMFGISIV

SEQ ID NO: 22476 - protein, 20 aa, Brucella spp.
WHFLGFAGIFTFVAFGRLYD

SEQ ID NO: 22477 - protein, 20 aa, Brucella spp.
PFHIIIGLLLIPYFLSNIQM

SEQ ID NO: 22478 - protein, 20 aa, Brucella spp.
SHFVFWLIVLLSLVFGVLII

SEQ ID NO: 22479 - protein, 20 aa, Brucella spp.
GLEPKWAYNIVASVGNYGEM

SEQ ID NO: 22480 - protein, 20 aa, Brucella spp.
SIRSHIPFLFEGKLPDFNIG

SEQ ID NO: 22481 - protein, 20 aa, Brucella spp.
HARIGMGVTVALLADPSIEA

SEQ ID NO: 22482 - protein, 20 aa, Brucella spp.
ESAEGFPIFLGGDHLLAAGT

SEQ ID NO: 22483 - protein, 20 aa, Brucella spp.
PHIIWPMRFVLPHSPQDRPA

SEQ ID NO: 22484 - protein, 20 aa, Brucella spp.
RPVGDAWIWLDARAASTVTR

SEQ ID NO: 22485 - protein, 20 aa, Brucella spp.
PVHWFFEMDLDFGISDPSII

SEQ ID NO: 22486 - protein, 20 aa, Brucella spp.
YKIYIFGFLFLKRLSDRFEE

SEQ ID NO: 22487 - protein, 20 aa, Brucella spp.
PVRLACIIVLLLLVAAVAGP

SEQ ID NO: 22488 - protein, 20 aa, Brucella spp.
EYGMGRELFRAFRQIAGRAD

SEQ ID NO: 22489 - protein, 20 aa, Brucella spp.
IAEPLGIRFLGVGGSPKWTL

SEQ ID NO: 22490 - protein, 20 aa, Brucella spp.
ANVSPTFNWVRLAQRVPVRV

SEQ ID NO: 22491 - protein, 20 aa, Brucella spp.
VVCISPWNFPLAIFTGQIAA

SEQ ID NO: 22492 - protein, 20 aa, Brucella spp.
QSFPGKWKVIFFYPKDFTFV

SEQ ID NO: 22493 - protein, 20 aa, Brucella spp.
CVSVLAFFWFARLAPDAGKE

SEQ ID NO: 22494 - protein, 20 aa, Brucella spp.
GEPKIGQLLFLPPHSIIDRR

SEQ ID NO: 22495 - protein, 20 aa, Brucella spp.
VSELFLFKILQPLVEHGLVE

SEQ ID NO: 22496 - protein, 20 aa, Brucella spp.
HFPELFRVVFAAGRRDEAGI

SEQ ID NO: 22497 - protein, 20 aa, Brucella spp.
PVLIEVLVFFAYWTIVLWFL

SEQ ID NO: 22498 - protein, 20 aa, Brucella spp.
EPEDAWDIAAFFQSKPRPAK

SEQ ID NO: 22499 - protein, 20 aa, Brucella spp.
FKPTVVGWVVGFNKKGKEED

SEQ ID NO: 22500 - protein, 20 aa, Brucella spp.
GEDMPVAIAIGVDPATILAA

SEQ ID NO: 22501 - protein, 20 aa, Brucella spp.
RLIPSCFPPIGLFDTVATAA

SEQ ID NO: 22502 - protein, 20 aa, Brucella spp.
WQFFDLTDFLTWKSCGSLAR

SEQ ID NO: 22503 - protein, 20 aa, Brucella spp.
FATRADLFFALRAEHPNLVG

SEQ ID NO: 22504 - protein, 20 aa, Brucella spp.
CLILLLLFIGFTAFAIPRIL

SEQ ID NO: 22505 - protein, 20 aa, Brucella spp.
VEFLFPYDFDADVIARELKQ

SEQ ID NO: 22506 - protein, 20 aa, Brucella spp.
SHAFSWHWLFLVNVGPGILV

SEQ ID NO: 22507 - protein, 20 aa, Brucella spp.
HGWNIPLATTARIWRAGCII

SEQ ID NO: 22508 - protein, 19 aa, Brucella spp.
ANHPECYLIVLLIDERPEE

SEQ ID NO: 22509 - protein, 19 aa, Brucella spp.
ILAEWKMQITLDARQLLRA

SEQ ID NO: 22510 - protein, 19 aa, Brucella spp.
RAVGFPVVLSRAFDRRTPS

SEQ ID NO: 22511 - protein, 19 aa, Brucella spp.
VKVEILGFTTKAWKGGQSR

SEQ ID NO: 22512 - protein, 19 aa, Brucella spp.
AFNIIIPFDDISGYGTPKD

SEQ ID NO: 22513 - protein, 19 aa, Brucella spp.
ETLLAKTFFNFGVEAVAFA

SEQ ID NO: 22514 - protein, 19 aa, Brucella spp.
IPMDAYFGIQTLRAVENFS

SEQ ID NO: 22515 - protein, 19 aa, Brucella spp.
EGIDWATAESLAFGSLAVE

SEQ ID NO: 22516 - protein, 19 aa, Brucella spp.
WATAESLAFGSLAVEAHPI

SEQ ID NO: 22517 - protein, 19 aa, Brucella spp.
DAALARRFQPVFVDEPTVE

SEQ ID NO: 22518 - protein, 19 aa, Brucella spp.
EATGGPAFGEYMITNEDVG

SEQ ID NO: 22519 - protein, 19 aa, Brucella spp.
PNEAFELIWQFLSLADPIF

SEQ ID NO: 22520 - protein, 19 aa, Brucella spp.
PHLWGLAIAQAWRKFSRRL

SEQ ID NO: 22521 - protein, 19 aa, Brucella spp.
YVGVLGLEFFVLKDGTLLA

SEQ ID NO: 22522 - protein, 19 aa, Brucella spp.
ERGFRLATYAMWWIKASIQ

SEQ ID NO: 22523 - protein, 19 aa, Brucella spp.
RDVSAFLMWAAEPHLEDRK

SEQ ID NO: 22524 - protein, 19 aa, Brucella spp.
LFDAIPFRQFVKADGRFVE

SEQ ID NO: 22525 - protein, 19 aa, Brucella spp.
ADLPFAICHMIGIRPKTQA

SEQ ID NO: 22526 - protein, 19 aa, Brucella spp.
KTGDLARIFNFLGEERHAG

SEQ ID NO: 22527 - protein, 19 aa, Brucella spp.
FPQNIYWIVGGVPKAGGIN

SEQ ID NO: 22528 - protein, 19 aa, Brucella spp.
SAYAYYIIGLSYFRQIPDV

SEQ ID NO: 22529 - protein, 19 aa, Brucella spp.
VFRQWGFPVNPLMKRFNSV

SEQ ID NO: 22530 - protein, 19 aa, Brucella spp.
IACDIPLPLGMEASEADAS

SEQ ID NO: 22531 - protein, 19 aa, Brucella spp.
AMNGEIAFEPALRERVALL

SEQ ID NO: 22532 - protein, 19 aa, Brucella spp.
REIRLPRALLALLIGASLG

SEQ ID NO: 22533 - protein, 19 aa, Brucella spp.
VALVIPFILIGWLMLLSLG

SEQ ID NO: 22534 - protein, 19 aa, Brucella spp.
FGLHIPKGYLYAAIGFSVL

SEQ ID NO: 22535 - protein, 19 aa, Brucella spp.
LPLRDAFAVLFFISVGMLF

SEQ ID NO: 22536 - protein, 19 aa, Brucella spp.
EPLGGLPWDMPLKAHEFHY

SEQ ID NO: 22537 - protein, 19 aa, Brucella spp.
VKFHPILCGTAFKNRGVQP

SEQ ID NO: 22538 - protein, 19 aa, Brucella spp.
PDCANGFILDGYPRTVPQA

SEQ ID NO: 22539 - protein, 19 aa, Brucella spp.
DGDRFIEIWNLVFMQFEQQ

SEQ ID NO: 22540 - protein, 19 aa, Brucella spp.
DGALDAYFFVGGYPTGAIS

SEQ ID NO: 22541 - protein, 19 aa, Brucella spp.
IAKLRAARLLWSRIMKEFD

SEQ ID NO: 22542 - protein, 19 aa, Brucella spp.
FYEEVVLLSQAFVINPDLT

SEQ ID NO: 22543 - protein, 19 aa, Brucella spp.
PFGPLRFDYAFPVAKADTD

SEQ ID NO: 22544 - protein, 19 aa, Brucella spp.
GFPTEMFTVLFALARTVGW

SEQ ID NO: 22545 - protein, 19 aa, Brucella spp.
KPIVEFMTFNFAMQAIDQI

SEQ ID NO: 22546 - protein, 19 aa, Brucella spp.
LDLPEGLRIGAIYRDGEMI

SEQ ID NO: 22547 - protein, 19 aa, Brucella spp.
LKLADGLAIAEFADKPLPV

SEQ ID NO: 22548 - protein, 19 aa, Brucella spp.
PVVLPARFPNLLVNGSGGI

SEQ ID NO: 22549 - protein, 19 aa, Brucella spp.
SLLAFGFVYWIARYGEARD

SEQ ID NO: 22550 - protein, 19 aa, Brucella spp.
HPSHFSLGEALEWIEKLSP

SEQ ID NO: 22551 - protein, 19 aa, Brucella spp.
FSLGEALEWIEKLSPKRAI

SEQ ID NO: 22552 - protein, 19 aa, Brucella spp.
GAQIIWVILRDFGQATQLS

SEQ ID NO: 22553 - protein, 19 aa, Brucella spp.
CWVAGYSFGAWIGMQLLMR

SEQ ID NO: 22554 - protein, 19 aa, Brucella spp.
TKTDIGWGHQIRSYVLQPY

SEQ ID NO: 22555 - protein, 19 aa, Brucella spp.
GRISHFGLLEMSRQRIRAS

SEQ ID NO: 22556 - protein, 19 aa, Brucella spp.
IEDEFSLEDDFTFEAEPET

SEQ ID NO: 22557 - protein, 19 aa, Brucella spp.
ASLIPMFIIIGVWGGKRRV

SEQ ID NO: 22558 - protein, 19 aa, Brucella spp.
AEVVKKWVLIDAEGLVVGR

SEQ ID NO: 22559 - protein, 19 aa, Brucella spp.
DAVSLFIGRLFPGYEVRGA

SEQ ID NO: 22560 - protein, 19 aa, Brucella spp.
KNPDAFPAWPDVILIDGGQ

SEQ ID NO: 22561 - protein, 19 aa, Brucella spp.
IMVQMGWGRLVSARFRATG

SEQ ID NO: 22562 - protein, 19 aa, Brucella spp.
RDWTLCLTLGALAELESVF

SEQ ID NO: 22563 - protein, 19 aa, Brucella spp.
CGSHWPFQQPVLVKLAQSG

SEQ ID NO: 22564 - protein, 19 aa, Brucella spp.
GALAWPFVYPWPQRPAGLV

SEQ ID NO: 22565 - protein, 19 aa, Brucella spp.
IHYHFPWPMSDIVQIGVRP

SEQ ID NO: 22566 - protein, 19 aa, Brucella spp.
RSVPLLYWLLSTVFISASR

SEQ ID NO: 22567 - protein, 19 aa, Brucella spp.
DRIPATIFVTGRWIKQNAE

SEQ ID NO: 22568 - protein, 19 aa, Brucella spp.
RLWIAFGLTGIFMIAEVIG

SEQ ID NO: 22569 - protein, 19 aa, Brucella spp.
DDILRAWAGLGYYSRARNL

SEQ ID NO: 22570 - protein, 19 aa, Brucella spp.
MTGDFPISMLVLGAVVSSS

SEQ ID NO: 22571 - protein, 19 aa, Brucella spp.
APMLWAIGFIFLFTIGGVT

SEQ ID NO: 22572 - protein, 19 aa, Brucella spp.
MLGWLWDPLFWIGMVLTVW

SEQ ID NO: 22573 - protein, 19 aa, Brucella spp.
SGLVEWPVVLMGEFEEEFL

SEQ ID NO: 22574 - protein, 19 aa, Brucella spp.
EGKEIGITMAFHRVKPPKP

SEQ ID NO: 22575 - protein, 19 aa, Brucella spp.
AAAHPAKVFSLVVSDIPGD

SEQ ID NO: 22576 - protein, 19 aa, Brucella spp.
EIANLPFILFESGFALNHI

SEQ ID NO: 22577 - protein, 19 aa, Brucella spp.
EQWRAGGLIIQFLPESELR

SEQ ID NO: 22578 - protein, 19 aa, Brucella spp.
FVCALPLYHIFALTVNAMI

SEQ ID NO: 22579 - protein, 19 aa, Brucella spp.
SEGNLLDALQEWFQKAGKA

SEQ ID NO: 22580 - protein, 19 aa, Brucella spp.
LCLLIILAATGGWYVYKNN

SEQ ID NO: 22581 - protein, 19 aa, Brucella spp.
IQWGADGSYVWRIENGIAK

SEQ ID NO: 22582 - protein, 19 aa, Brucella spp.
KWFTPRAVVGFWPANAVGD

SEQ ID NO: 22583 - protein, 19 aa, Brucella spp.
LAAVFSWYTFLATPASPVK

SEQ ID NO: 22584 - protein, 19 aa, Brucella spp.
LTSWRLAFLVLLAALIAGF

SEQ ID NO: 22585 - protein, 19 aa, Brucella spp.
LSIWLKLKIRRAGKIHEMS

SEQ ID NO: 22586 - protein, 19 aa, Brucella spp.
ALRLYRGLGLWGLFVPTAI

SEQ ID NO: 22587 - protein, 19 aa, Brucella spp.
RNVGFVFQHYALFRHMTVA

SEQ ID NO: 22588 - protein, 19 aa, Brucella spp.
SVLPRSIATFSAFENAMTL

SEQ ID NO: 22589 - protein, 19 aa, Brucella spp.
EGVPLVVFAGVEYGNGSSR

SEQ ID NO: 22590 - protein, 19 aa, Brucella spp.
EGPLYHHIGLYAYRRSALE

SEQ ID NO: 22591 - protein, 19 aa, Brucella spp.
GRIAQAWMLTGVRGVGKTT

SEQ ID NO: 22592 - protein, 19 aa, Brucella spp.
CQRNIPLVFLQNITGFMVG

SEQ ID NO: 22593 - protein, 19 aa, Brucella spp.
LVAGSEWGRVRALVNDRGE

SEQ ID NO: 22594 - protein, 19 aa, Brucella spp.
GKVERGAGVRLIRDNVVIH

SEQ ID NO: 22595 - protein, 19 aa, Brucella spp.
LPLLAGLIAAPFVVTGCTT

SEQ ID NO: 22596 - protein, 19 aa, Brucella spp.
SPWEFFFGTVWDPRFAAAG

SEQ ID NO: 22597 - protein, 19 aa, Brucella spp.
ESLWLLLHWWLEGGIATRM

SEQ ID NO: 22598 - protein, 19 aa, Brucella spp.
MPRMDGMELLRRLRQKSDL

SEQ ID NO: 22599 - protein, 19 aa, Brucella spp.
GRKTPLLCFGVFDGPSDEQ

SEQ ID NO: 22600 - protein, 19 aa, Brucella spp.
RVIEWSRLIWYPILYGIVL

SEQ ID NO: 22601 - protein, 19 aa, Brucella spp.
SRPGGLLRYGIPDFKMEKH

SEQ ID NO: 22602 - protein, 19 aa, Brucella spp.
LAGAFLLGGLIGFERQFRH

SEQ ID NO: 22603 - protein, 19 aa, Brucella spp.
LKDGFDWLLMLHGTSGHNY

SEQ ID NO: 22604 - protein, 19 aa, Brucella spp.
EFRKRFPLIELFDVIVDAT

SEQ ID NO: 22605 - protein, 19 aa, Brucella spp.
YNVQGAAGFSDRLRALNEA

SEQ ID NO: 22606 - protein, 19 aa, Brucella spp.
LTQAEGWIGRTLTNADGSI

SEQ ID NO: 22607 - protein, 19 aa, Brucella spp.
QELNTGVPIIYRLNADSTV

SEQ ID NO: 22608 - protein, 19 aa, Brucella spp.
SSLSWPWLFVINIPLGIAA

SEQ ID NO: 22609 - protein, 19 aa, Brucella spp.
RPIEVGFLMMPWPIALALV

SEQ ID NO: 22610 - protein, 19 aa, Brucella spp.
VGFLMMPWPIALALVAPLS

SEQ ID NO: 22611 - protein, 19 aa, Brucella spp.
CVEAWSMVIPWIGFPLSSL

SEQ ID NO: 22612 - protein, 19 aa, Brucella spp.
DFDQAIALNPNFYQAYANR

SEQ ID NO: 22613 - protein, 19 aa, Brucella spp.
VSNRLFSIRAGWLVHDRKP

SEQ ID NO: 22614 - protein, 19 aa, Brucella spp.
DPSLSFGLPAFLARKPGLN

SEQ ID NO: 22615 - protein, 19 aa, Brucella spp.
LTLAEALRMASLYPARYLR

SEQ ID NO: 22616 - protein, 19 aa, Brucella spp.
YPVNELWEVITGRIAGRKD

SEQ ID NO: 22617 - protein, 19 aa, Brucella spp.
VVPVFPLKGALLLPGGQLP

SEQ ID NO: 22618 - protein, 19 aa, Brucella spp.
GRAFFALIAIIAVFSFLSP

SEQ ID NO: 22619 - protein, 19 aa, Brucella spp.
LERLNEFPVPVVTRDEQIR

SEQ ID NO: 22620 - protein, 19 aa, Brucella spp.
LTGAVLIAAFVAPFYGALD

SEQ ID NO: 22621 - protein, 19 aa, Brucella spp.
CGMQARTAFRQWLRSRAVM

SEQ ID NO: 22622 - protein, 19 aa, Brucella spp.
ELRIPPFPGGRTFRSPLLI

SEQ ID NO: 22623 - protein, 19 aa, Brucella spp.
DLPETVAARAIWTGDWQAD

SEQ ID NO: 22624 - protein, 19 aa, Brucella spp.
PIGVCGLITPWNWPMNQIT

SEQ ID NO: 22625 - protein, 19 aa, Brucella spp.
LLIDDLLPFADHPKVIGLA

SEQ ID NO: 22626 - protein, 19 aa, Brucella spp.
GLEPVRLRPGMYIGGTDEK

SEQ ID NO: 22627 - protein, 19 aa, Brucella spp.
RGQALRVLLYLFGRDEAIR

SEQ ID NO: 22628 - protein, 19 aa, Brucella spp.
HAGPMPVVFDHLVHEALTE

SEQ ID NO: 22629 - protein, 19 aa, Brucella spp.
EEYGIVFDFDAIIRAPNTL

SEQ ID NO: 22630 - protein, 19 aa, Brucella spp.
VVWNMVVFTLFIVRPGEWV

SEQ ID NO: 22631 - protein, 19 aa, Brucella spp.
DFRVKVIWVNSWFDPGKEA

SEQ ID NO: 22632 - protein, 19 aa, Brucella spp.
ANGRKLVIGYILRHHLSWM

SEQ ID NO: 22633 - protein, 19 aa, Brucella spp.
LEFVRVVALARILMPKSHV

SEQ ID NO: 22634 - protein, 19 aa, Brucella spp.
AATGGFTWLVTYFEPLVIY

SEQ ID NO: 22635 - protein, 19 aa, Brucella spp.
DEFPLIFAGLQNGPDPSSI

SEQ ID NO: 22636 - protein, 19 aa, Brucella spp.
IPAGEKITLMWASANRDEA

SEQ ID NO: 22637 - protein, 19 aa, Brucella spp.
PRWPMIILRSPKGWTGPKT

SEQ ID NO: 22638 - protein, 19 aa, Brucella spp.
EENNLGFEIGKGVVPIVPA

SEQ ID NO: 22639 - protein, 19 aa, Brucella spp.
AYARKFRFPTFLGAFKYYT

SEQ ID NO: 22640 - protein, 19 aa, Brucella spp.
QGLSLTLFFRDTATTRDIN

SEQ ID NO: 22641 - protein, 19 aa, Brucella spp.
IEGPLVMLLALLEGKLDGD

SEQ ID NO: 22642 - protein, 19 aa, Brucella spp.
VPEGFAFDVTRPWDMQLLV

SEQ ID NO: 22643 - protein, 19 aa, Brucella spp.
RLWPLKYIIFLGLFALSLY

SEQ ID NO: 22644 - protein, 19 aa, Brucella spp.
FEMAWQRKLPLLLKGPTGC

SEQ ID NO: 22645 - protein, 19 aa, Brucella spp.
LALPCGLRACWSMPAINGA

SEQ ID NO: 22646 - protein, 19 aa, Brucella spp.
VRLAGFVGIPSFNRGNALH

SEQ ID NO: 22647 - protein, 19 aa, Brucella spp.
ELNVFKPVIAYNVLQSIRL

SEQ ID NO: 22648 - protein, 19 aa, Brucella spp.
LIQPWEFIIILGAALGTFF

SEQ ID NO: 22649 - protein, 18 aa, Brucella spp.
IPSGLDFDAISGLSNELK

SEQ ID NO: 22650 - protein, 18 aa, Brucella spp.
AHLEGVSPAWPFSYDELE

SEQ ID NO: 22651 - protein, 18 aa, Brucella spp.
VSPAWPFSYDELEPWYCK

SEQ ID NO: 22652 - protein, 18 aa, Brucella spp.
ALAYRFSARMNLAGIEAA

SEQ ID NO: 22653 - protein, 18 aa, Brucella spp.
LGGTLTWYGESGFYVDGQ

SEQ ID NO: 22654 - protein, 18 aa, Brucella spp.
AHVLPQLHVLIWGNRRGV

SEQ ID NO: 22655 - protein, 18 aa, Brucella spp.
LKLFPILYKAFTEKDMSL

SEQ ID NO: 22656 - protein, 18 aa, Brucella spp.
IEAEIGFIVCITEGIPVM

SEQ ID NO: 22657 - protein, 18 aa, Brucella spp.
PSFTQPLMYKAIRAHKTT

SEQ ID NO: 22658 - protein, 18 aa, Brucella spp.
IADLNAWFGAVANRIVAT

SEQ ID NO: 22659 - protein, 18 aa, Brucella spp.
RATFSIIWLSGWAPHESQ

SEQ ID NO: 22660 - protein, 18 aa, Brucella spp.
VNMTLCFSANQALLAAKA

SEQ ID NO: 22661 - protein, 18 aa, Brucella spp.
TQLEREWFRLLQNVQGVG

SEQ ID NO: 22662 - protein, 18 aa, Brucella spp.
GKFFSMLFAIESQRAAMD

SEQ ID NO: 22663 - protein, 18 aa, Brucella spp.
AQLDRFLMQIDILYPELA

SEQ ID NO: 22664 - protein, 18 aa, Brucella spp.
LLWILGVVIFLLMMATAF

SEQ ID NO: 22665 - protein, 18 aa, Brucella spp.
VIVFLVLFAGLVYIAKRS

SEQ ID NO: 22666 - protein, 18 aa, Brucella spp.
PLALPAFRRRLAVAQASI

SEQ ID NO: 22667 - protein, 18 aa, Brucella spp.
HYLFDLWTFITDRLTKAG

SEQ ID NO: 22668 - protein, 18 aa, Brucella spp.
HLEDRAWRISLFGDEIET

SEQ ID NO: 22669 - protein, 18 aa, Brucella spp.
GAFDVLVGINLLREGLDI

SEQ ID NO: 22670 - protein, 18 aa, Brucella spp.
RIGMPVGEAVAFMPRAPY

SEQ ID NO: 22671 - protein, 18 aa, Brucella spp.
VTKIPRFAFEKFPGSSPI

SEQ ID NO: 22672 - protein, 18 aa, Brucella spp.
IGVAIALIIFFSYQLDAD

SEQ ID NO: 22673 - protein, 18 aa, Brucella spp.
VQRGFLFAALKGVKADGA

SEQ ID NO: 22674 - protein, 18 aa, Brucella spp.
EIELPLAGDFQVANALVA

SEQ ID NO: 22675 - protein, 18 aa, Brucella spp.
PRGPMGLLKRLTHGLSRR

SEQ ID NO: 22676 - protein, 18 aa, Brucella spp.
GSNRPIYFLIGAAVLGFW

SEQ ID NO: 22677 - protein, 18 aa, Brucella spp.
VLSFTAFLFTVDFSSQAG

SEQ ID NO: 22678 - protein, 18 aa, Brucella spp.
AGIPESFNVLVKEMRSLG

SEQ ID NO: 22679 - protein, 18 aa, Brucella spp.
RIWFTLGALLVYRFGTYI

SEQ ID NO: 22680 - protein, 18 aa, Brucella spp.
ETAFKLYDTYGFPLDLTQ

SEQ ID NO: 22681 - protein, 18 aa, Brucella spp.
AHPDLFNILLQVMDHGAL

SEQ ID NO: 22682 - protein, 18 aa, Brucella spp.
IIRGFKFNGIGPYQDAKN

SEQ ID NO: 22683 - protein, 18 aa, Brucella spp.
MFTVLFALARTVGWVAQW

SEQ ID NO: 22684 - protein, 18 aa, Brucella spp.
LLIVLALVGVVLIQRSEG

SEQ ID NO: 22685 - protein, 18 aa, Brucella spp.
RLVFLDIWLQGSRLDGLA

SEQ ID NO: 22686 - protein, 18 aa, Brucella spp.
YAVLPLRDIVVFPHMIVP

SEQ ID NO: 22687 - protein, 18 aa, Brucella spp.
LGVEKFRFGQIDGEDQVG

SEQ ID NO: 22688 - protein, 18 aa, Brucella spp.
AAFMPRFDASGLITAIVT

SEQ ID NO: 22689 - protein, 18 aa, Brucella spp.
TSGHWGWYRDNMFKVTVA

SEQ ID NO: 22690 - protein, 18 aa, Brucella spp.
PEVIRRLGIIGINTALEF

SEQ ID NO: 22691 - protein, 18 aa, Brucella spp.
SVACPFPITGAAVGEDES

SEQ ID NO: 22692 - protein, 18 aa, Brucella spp.
PIEVNRFGLGATIRAIEA

SEQ ID NO: 22693 - protein, 18 aa, Brucella spp.
PHMVQSWNLLGFDEENAE

SEQ ID NO: 22694 - protein, 18 aa, Brucella spp.
SPLLMWAALGGFNIMAAV

SEQ ID NO: 22695 - protein, 18 aa, Brucella spp.
EPPARALFILISHSSGRL

SEQ ID NO: 22696 - protein, 18 aa, Brucella spp.
VGVSIPIYTGGRTSAQIR

SEQ ID NO: 22697 - protein, 18 aa, Brucella spp.
LSRDYLFYLMARGIPENE

SEQ ID NO: 22698 - protein, 18 aa, Brucella spp.
LRLDILRGLLAAHDRSKG

SEQ ID NO: 22699 - protein, 18 aa, Brucella spp.
MIFMLRIPKMPVADAKHL

SEQ ID NO: 22700 - protein, 18 aa, Brucella spp.
DSSMALHIIRGIEDYLLR

SEQ ID NO: 22701 - protein, 18 aa, Brucella spp.
IGYPVIIKASAGGGGRGM

SEQ ID NO: 22702 - protein, 18 aa, Brucella spp.
LEEIVAWLATWTGKRTPQ

SEQ ID NO: 22703 - protein, 18 aa, Brucella spp.
ALEYPYFPQPILRPGDIY

SEQ ID NO: 22704 - protein, 18 aa, Brucella spp.
DLILVMTVNPGFGGQKFI

SEQ ID NO: 22705 - protein, 18 aa, Brucella spp.
SATPEMAKLIALNAEGAG

SEQ ID NO: 22706 - protein, 18 aa, Brucella spp.
ATWPEAFAAIAAKVSATS

SEQ ID NO: 22707 - protein, 18 aa, Brucella spp.
DVAHIFNFITGYAQPAEE

SEQ ID NO: 22708 - protein, 18 aa, Brucella spp.
IPPLLVIFFWYFGVLSVL

SEQ ID NO: 22709 - protein, 18 aa, Brucella spp.
VHGSPIPFAISFDTNAIE

SEQ ID NO: 22710 - protein, 18 aa, Brucella spp.
SYKIEMGKLMLLDESDKE

SEQ ID NO: 22711 - protein, 18 aa, Brucella spp.
DDDLPVWVPLPALAEIQV

SEQ ID NO: 22712 - protein, 18 aa, Brucella spp.
REEVYIANTIPWRPPGNR

SEQ ID NO: 22713 - protein, 18 aa, Brucella spp.
SYMALAFGFAFYCQYLLQ

SEQ ID NO: 22714 - protein, 18 aa, Brucella spp.
AHVLIALCDLARIFNTET

SEQ ID NO: 22715 - protein, 18 aa, Brucella spp.
GIPPDLFREGQGVVAEGR

SEQ ID NO: 22716 - protein, 18 aa, Brucella spp.
IRGIMPFAKGGVVSSPTY

SEQ ID NO: 22717 - protein, 18 aa, Brucella spp.
WVSGMALGLPPFAGKPSG

SEQ ID NO: 22718 - protein, 18 aa, Brucella spp.
AHDAVFFRTRPDFVFKPT

SEQ ID NO: 22719 - protein, 18 aa, Brucella spp.
FQKLFGLHVTGEIDSALI

SEQ ID NO: 22720 - protein, 18 aa, Brucella spp.
AFWLSLAFIAVPHFFPAD

SEQ ID NO: 22721 - protein, 18 aa, Brucella spp.
RPSFCQACIFWIESQKFE

SEQ ID NO: 22722 - protein, 18 aa, Brucella spp.
DVATFSFFGNKTITTGEG

SEQ ID NO: 22723 - protein, 18 aa, Brucella spp.
YWLEATLIVFALIIAINV

SEQ ID NO: 22724 - protein, 18 aa, Brucella spp.
LAFVVRFGFVFVPNLAQL

SEQ ID NO: 22725 - protein, 18 aa, Brucella spp.
GRRLALGKLLPMQRSDFA

SEQ ID NO: 22726 - protein, 18 aa, Brucella spp.
EIMKGLPVTIRLLDPPLH

SEQ ID NO: 22727 - protein, 18 aa, Brucella spp.
HFVDVVWLFLFFAIYVWG

SEQ ID NO: 22728 - protein, 18 aa, Brucella spp.
ASALFYFGKLQFDAQGPL

SEQ ID NO: 22729 - protein, 18 aa, Brucella spp.
LQSDPTIIYGLFGGAGKP

SEQ ID NO: 22730 - protein, 18 aa, Brucella spp.
GSFDTGFLAALPGFVVMA

SEQ ID NO: 22731 - protein, 18 aa, Brucella spp.
VPLEESIRIYERGEALKK

SEQ ID NO: 22732 - protein, 18 aa, Brucella spp.
SCGPVLADLLSFFHDRFK

SEQ ID NO: 22733 - protein, 18 aa, Brucella spp.
YVLLPLEVAPLFKDWLLR

SEQ ID NO: 22734 - protein, 18 aa, Brucella spp.
DGIVHAITFEYTANRDGK

SEQ ID NO: 22735 - protein, 18 aa, Brucella spp.
RAFKAGWGGVVWKTLGAE

SEQ ID NO: 22736 - protein, 18 aa, Brucella spp.
ADGSYVWRIENGIAKKIP

SEQ ID NO: 22737 - protein, 18 aa, Brucella spp.
FEDAIPLANRIAAEHLEI

SEQ ID NO: 22738 - protein, 18 aa, Brucella spp.
NIPIVPLYFAARRPVVER

SEQ ID NO: 22739 - protein, 18 aa, Brucella spp.
AMHAVFLYHAIQAGMDMG

SEQ ID NO: 22740 - protein, 18 aa, Brucella spp.
VAAIALAAVFSWYTFLAT

SEQ ID NO: 22741 - protein, 18 aa, Brucella spp.
VSFLPSPDTFSMVEFDYE

SEQ ID NO: 22742 - protein, 18 aa, Brucella spp.
KDGMTVEVAMWWNDSYHE

SEQ ID NO: 22743 - protein, 18 aa, Brucella spp.
VVPTHFAVIFDYSSKTFR

SEQ ID NO: 22744 - protein, 18 aa, Brucella spp.
LRTLFTLLAIFPAMDASY

SEQ ID NO: 22745 - protein, 18 aa, Brucella spp.
VPVEHWFKLGRLLVPVGW

SEQ ID NO: 22746 - protein, 18 aa, Brucella spp.
RLNIPVVFVSGGPMEAGK

SEQ ID NO: 22747 - protein, 18 aa, Brucella spp.
LSLFWHFLDIIWIGVFTL

SEQ ID NO: 22748 - protein, 18 aa, Brucella spp.
ASQPWPFPYSLMIGCHAE

SEQ ID NO: 22749 - protein, 18 aa, Brucella spp.
NWTGIRWVVTVARDVAGQ

SEQ ID NO: 22750 - protein, 18 aa, Brucella spp.
ELTAGAFTHSFRIEAQAL

SEQ ID NO: 22751 - protein, 18 aa, Brucella spp.
HPGDILVAGSEWGRVRAL

SEQ ID NO: 22752 - protein, 18 aa, Brucella spp.
GTKEFPLVIKGDVQGSIE

SEQ ID NO: 22753 - protein, 18 aa, Brucella spp.
TAPLLLIGMVAFVADVPA

SEQ ID NO: 22754 - protein, 18 aa, Brucella spp.
IHEPEAFAALVASAKKAL

SEQ ID NO: 22755 - protein, 18 aa, Brucella spp.
AFVLPLVALFFLIRLFGP

SEQ ID NO: 22756 - protein, 18 aa, Brucella spp.
EVSLPRLLLPALSANGDS

SEQ ID NO: 22757 - protein, 18 aa, Brucella spp.
LTVTEFLILHSLAQRPGV

SEQ ID NO: 22758 - protein, 18 aa, Brucella spp.
QGRLPIRVELSALTREDF

SEQ ID NO: 22759 - protein, 18 aa, Brucella spp.
RIVIFPLYPQYSATTTAT

SEQ ID NO: 22760 - protein, 18 aa, Brucella spp.
LNLIVPFFDRVGARLNMM

SEQ ID NO: 22761 - protein, 18 aa, Brucella spp.
ANVAFALWREDIRPSVEG

SEQ ID NO: 22762 - protein, 18 aa, Brucella spp.
EDKLSVWPYWATKMRTSS

SEQ ID NO: 22763 - protein, 18 aa, Brucella spp.
QPGHYGVGYIFMPRDPDL

SEQ ID NO: 22764 - protein, 18 aa, Brucella spp.
EELVMSLVSFIGPRPNIF

SEQ ID NO: 22765 - protein, 18 aa, Brucella spp.
DPDLKIMFITGFAAVALN

SEQ ID NO: 22766 - protein, 18 aa, Brucella spp.
MVGLVPLPWAYFPWLAAT

SEQ ID NO: 22767 - protein, 18 aa, Brucella spp.
LDEFPSLYEAIRYDSERK

SEQ ID NO: 22768 - protein, 18 aa, Brucella spp.
FDNGFSLSTGARYDYSRF

SEQ ID NO: 22769 - protein, 18 aa, Brucella spp.
GVLFCFAAFIGFEATTVY

SEQ ID NO: 22770 - protein, 18 aa, Brucella spp.
NELDLFYGVEFRKRFPLI

SEQ ID NO: 22771 - protein, 18 aa, Brucella spp.
MRPLPVLEPYKLVRSLRM

SEQ ID NO: 22772 - protein, 18 aa, Brucella spp.
QTGLFSWSGSPAIPGAGL

SEQ ID NO: 22773 - protein, 18 aa, Brucella spp.
GMKQVLFGMGCFWGAERL

SEQ ID NO: 22774 - protein, 18 aa, Brucella spp.
QNLALVWVICGALLTIFV

SEQ ID NO: 22775 - protein, 18 aa, Brucella spp.
LLFKKSWIFIRGVPSMKF

SEQ ID NO: 22776 - protein, 18 aa, Brucella spp.
PIRLVVPWKYGFKGIKAI

SEQ ID NO: 22777 - protein, 18 aa, Brucella spp.
LGMLCFFSSYVLRDAFAE

SEQ ID NO: 22778 - protein, 18 aa, Brucella spp.
LPGCTRLSLLQLITETGM

SEQ ID NO: 22779 - protein, 18 aa, Brucella spp.
WREIMYKFALTMTPEQAE

SEQ ID NO: 22780 - protein, 18 aa, Brucella spp.
QAEAVALRLYVDMLEAGF

SEQ ID NO: 22781 - protein, 18 aa, Brucella spp.
LTLLPVFYAHSGFGGAAA

SEQ ID NO: 22782 - protein, 18 aa, Brucella spp.
EEVAALGLPYRFELMNRW

SEQ ID NO: 22783 - protein, 18 aa, Brucella spp.
SDRPELVLDWTLPQNSSI

SEQ ID NO: 22784 - protein, 18 aa, Brucella spp.
DEQLDFPILYGSGRNGWM

SEQ ID NO: 22785 - protein, 18 aa, Brucella spp.
ATINIDWILQVAADLMST

SEQ ID NO: 22786 - protein, 18 aa, Brucella spp.
MPAELRITGGAARSKALR

SEQ ID NO: 22787 - protein, 18 aa, Brucella spp.
GEIVCIYGLMGAGRTELL

SEQ ID NO: 22788 - protein, 18 aa, Brucella spp.
RDLIDLLLIFADLEQSPS

SEQ ID NO: 22789 - protein, 18 aa, Brucella spp.
DAIYACWLIFRLCCIPLF

SEQ ID NO: 22790 - protein, 18 aa, Brucella spp.
IPALVLLVAVMIGYSLYN

SEQ ID NO: 22791 - protein, 18 aa, Brucella spp.
CVAALRPLGAFAQDAHQH

SEQ ID NO: 22792 - protein, 18 aa, Brucella spp.
LVSAMAWLTIPAMVGPLV

SEQ ID NO: 22793 - protein, 18 aa, Brucella spp.
LSPIEILILHSIRHRDRE

SEQ ID NO: 22794 - protein, 18 aa, Brucella spp.
LPAPCLPGFDTLATLKHI

SEQ ID NO: 22795 - protein, 18 aa, Brucella spp.
HGIPFRFPSSPDIGPGLT

SEQ ID NO: 22796 - protein, 18 aa, Brucella spp.
CNELKVMIDLSHMNEKGF

SEQ ID NO: 22797 - protein, 18 aa, Brucella spp.
PFLQLAFIALPVIPHLKI

SEQ ID NO: 22798 - protein, 18 aa, Brucella spp.
HEIPHVFPDEVLREAETA

SEQ ID NO: 22799 - protein, 18 aa, Brucella spp.
VEALPVAGAVRFEMVSEP

SEQ ID NO: 22800 - protein, 18 aa, Brucella spp.
ASRLLEWVIDRADERLRR

SEQ ID NO: 22801 - protein, 18 aa, Brucella spp.
PVLPEWIDAPLLAREGFP

SEQ ID NO: 22802 - protein, 18 aa, Brucella spp.
VQHLLKIVYIKALCRRAN

SEQ ID NO: 22803 - protein, 18 aa, Brucella spp.
VVCPWCFLGRKRLEAALA

SEQ ID NO: 22804 - protein, 18 aa, Brucella spp.
EKLKVGFIYIGPPGDFGW

SEQ ID NO: 22805 - protein, 18 aa, Brucella spp.
YAIFFKLVLPLIRPAMAT

SEQ ID NO: 22806 - protein, 18 aa, Brucella spp.
ATFVGLFFFGWDRLSKVG

SEQ ID NO: 22807 - protein, 18 aa, Brucella spp.
VPINMLIPMPGTRLAKAA

SEQ ID NO: 22808 - protein, 18 aa, Brucella spp.
VDPLEFVRVVALARILMP

SEQ ID NO: 22809 - protein, 18 aa, Brucella spp.
SPRLINWLLVGLGLGGLF

SEQ ID NO: 22810 - protein, 18 aa, Brucella spp.
PLWKDLKVRQAFMHAINR

SEQ ID NO: 22811 - protein, 18 aa, Brucella spp.
GAIVMPPVPAFYLQPQTV

SEQ ID NO: 22812 - protein, 18 aa, Brucella spp.
TVLFPDFHRQSGSYFAGV

SEQ ID NO: 22813 - protein, 18 aa, Brucella spp.
PEPGYDFIIQGIGGLMSI

SEQ ID NO: 22814 - protein, 18 aa, Brucella spp.
LEDAVLLVMSRFNRILEI

SEQ ID NO: 22815 - protein, 18 aa, Brucella spp.
LTVLMTLPATWVARYSSK

SEQ ID NO: 22816 - protein, 18 aa, Brucella spp.
LSLLDKFDWWGLFGMAAF

SEQ ID NO: 22817 - protein, 18 aa, Brucella spp.
RIAPILLAVAAKYQGEPC

SEQ ID NO: 22818 - protein, 18 aa, Brucella spp.
MAFLRPFDCSTLWHGEKL

SEQ ID NO: 22819 - protein, 17 aa, Brucella spp.
GLSERLLSFGFTLGRLK

SEQ ID NO: 22820 - protein, 17 aa, Brucella spp.
WKMQITLDARQLLRASL

SEQ ID NO: 22821 - protein, 17 aa, Brucella spp.
IPSGILFDMHREAAARR

SEQ ID NO: 22822 - protein, 17 aa, Brucella spp.
GAASILWHDSTRAKDAA

SEQ ID NO: 22823 - protein, 17 aa, Brucella spp.
LELKALATLGLDANSTG

SEQ ID NO: 22824 - protein, 17 aa, Brucella spp.
LKALATLGLDANSTGDK

SEQ ID NO: 22825 - protein, 17 aa, Brucella spp.
AEMGGGGGLGIILNTGT

SEQ ID NO: 22826 - protein, 17 aa, Brucella spp.
MGGGGGLGIILNTGTLV

SEQ ID NO: 22827 - protein, 17 aa, Brucella spp.
TDSAFNIIIPFDDISGY

SEQ ID NO: 22828 - protein, 17 aa, Brucella spp.
LYIAVGISGAIQHLAGM

SEQ ID NO: 22829 - protein, 17 aa, Brucella spp.
DDLEPFAAKDFARAIAG

SEQ ID NO: 22830 - protein, 17 aa, Brucella spp.
VEECGLTHLHVFPYSPR

SEQ ID NO: 22831 - protein, 17 aa, Brucella spp.
TEGIPVMDIVRVKERLE

SEQ ID NO: 22832 - protein, 17 aa, Brucella spp.
MIHELAVLMEFGGSSED

SEQ ID NO: 22833 - protein, 17 aa, Brucella spp.
SFKAELDTYVSVAPQDA

SEQ ID NO: 22834 - protein, 17 aa, Brucella spp.
LGFPVWAVPTVVLPWHP

SEQ ID NO: 22835 - protein, 17 aa, Brucella spp.
DHFIFLGLRELVFEGTG

SEQ ID NO: 22836 - protein, 17 aa, Brucella spp.
ARLCAARLLGAVIEKNT

SEQ ID NO: 22837 - protein, 17 aa, Brucella spp.
LFSLECWGGATFDVSMR

SEQ ID NO: 22838 - protein, 17 aa, Brucella spp.
LQTMGFRQFVPIVAACP

SEQ ID NO: 22839 - protein, 17 aa, Brucella spp.
IGDRFRFGTALIEVSQG

SEQ ID NO: 22840 - protein, 17 aa, Brucella spp.
RGLQPLLIGMAFDCQEV

SEQ ID NO: 22841 - protein, 17 aa, Brucella spp.
ASARFLFATWRSAWEAR

SEQ ID NO: 22842 - protein, 17 aa, Brucella spp.
RFSDVANVFGFDTDGSI

SEQ ID NO: 22843 - protein, 17 aa, Brucella spp.
SNAACVFGGGFIGRSER

SEQ ID NO: 22844 - protein, 17 aa, Brucella spp.
DGVMTFAVRSGGAVFPV

SEQ ID NO: 22845 - protein, 17 aa, Brucella spp.
SEKWGIDAIHGLVRTQS

SEQ ID NO: 22846 - protein, 17 aa, Brucella spp.
HLMELLIMIDAFRRSSA

SEQ ID NO: 22847 - protein, 17 aa, Brucella spp.
IDFDLLILDVMMPGETG

SEQ ID NO: 22848 - protein, 17 aa, Brucella spp.
FEYIPDNALVFIDESHV

SEQ ID NO: 22849 - protein, 17 aa, Brucella spp.
YIPDNALVFIDESHVTV

SEQ ID NO: 22850 - protein, 17 aa, Brucella spp.
KDVTIGQSLVWKELPWT

SEQ ID NO: 22851 - protein, 17 aa, Brucella spp.
FQAIIIWRDQLNESNIL

SEQ ID NO: 22852 - protein, 17 aa, Brucella spp.
TAIELVELIGKKPWLLE

SEQ ID NO: 22853 - protein, 17 aa, Brucella spp.
QGMESGFFWYVTAIMVV

SEQ ID NO: 22854 - protein, 17 aa, Brucella spp.
PRFLAWPLWLLAELAIC

SEQ ID NO: 22855 - protein, 17 aa, Brucella spp.
NHWGVPLTLARMPADVD

SEQ ID NO: 22856 - protein, 17 aa, Brucella spp.
WGVPLTLARMPADVDYG

SEQ ID NO: 22857 - protein, 17 aa, Brucella spp.
QVVIRFWIVAIILAMIG

SEQ ID NO: 22858 - protein, 17 aa, Brucella spp.
SSFPQNIYWIVGGVPKA

SEQ ID NO: 22859 - protein, 17 aa, Brucella spp.
ALHRFLFGLGIRHVGEV

SEQ ID NO: 22860 - protein, 17 aa, Brucella spp.
AALWWSKPLAWILARRE

SEQ ID NO: 22861 - protein, 17 aa, Brucella spp.
GKLSVGHDFGFRGNMLV

SEQ ID NO: 22862 - protein, 17 aa, Brucella spp.
PQLPLFRALSMRAANFP

SEQ ID NO: 22863 - protein, 17 aa, Brucella spp.
AALPFFQMIPSFALWPM

SEQ ID NO: 22864 - protein, 17 aa, Brucella spp.
NEMKLIVDLIYEGGIAN

SEQ ID NO: 22865 - protein, 17 aa, Brucella spp.
VIIGLAGLFLWAKSRGR

SEQ ID NO: 22866 - protein, 17 aa, Brucella spp.
YAMPRAGWWGFAALTEG

SEQ ID NO: 22867 - protein, 17 aa, Brucella spp.
TLSHSFNEQWGIKGMVD

SEQ ID NO: 22868 - protein, 17 aa, Brucella spp.
VMREIRLPRALLALLIG

SEQ ID NO: 22869 - protein, 17 aa, Brucella spp.
RSWWRFVVTFKLESFLA

SEQ ID NO: 22870 - protein, 17 aa, Brucella spp.
ICGGFQMLGRRISDPAG

SEQ ID NO: 22871 - protein, 17 aa, Brucella spp.
ERRAASPLPTFRLTTGL

SEQ ID NO: 22872 - protein, 17 aa, Brucella spp.
RAASPLPTFRLTTGLNK

SEQ ID NO: 22873 - protein, 17 aa, Brucella spp.
ADLAMAFYNPISKARPH

SEQ ID NO: 22874 - protein, 17 aa, Brucella spp.
IEPAYGWKRKATVAHAH

SEQ ID NO: 22875 - protein, 17 aa, Brucella spp.
QGHLCAAGVVFLALVQV

SEQ ID NO: 22876 - protein, 17 aa, Brucella spp.
GDLGRFLFNNIGCSVHV

SEQ ID NO: 22877 - protein, 17 aa, Brucella spp.
EGDPILLIHGFASSSLV

SEQ ID NO: 22878 - protein, 17 aa, Brucella spp.
FMDPVLYLKGFHAIQTH

SEQ ID NO: 22879 - protein, 17 aa, Brucella spp.
TDIGFPLTIGAGCTIGH

SEQ ID NO: 22880 - protein, 17 aa, Brucella spp.
LALGRNVLVAFMPWNGY

SEQ ID NO: 22881 - protein, 17 aa, Brucella spp.
LGRNVLVAFMPWNGYNY

SEQ ID NO: 22882 - protein, 17 aa, Brucella spp.
LRPLVPLDGGRFATSDL

SEQ ID NO: 22883 - protein, 17 aa, Brucella spp.
LYDTYGFPLDLTQDALR

SEQ ID NO: 22884 - protein, 17 aa, Brucella spp.
SALKWSGGYVWACKNYD

SEQ ID NO: 22885 - protein, 17 aa, Brucella spp.
LKWSGGYVWACKNYDGD

SEQ ID NO: 22886 - protein, 17 aa, Brucella spp.
WSGGYVWACKNYDGDVQ

SEQ ID NO: 22887 - protein, 17 aa, Brucella spp.
LENFFWWTLEDIAARDN

SEQ ID NO: 22888 - protein, 17 aa, Brucella spp.
DWEGWKYLTDLIGNKCQ

SEQ ID NO: 22889 - protein, 17 aa, Brucella spp.
DENAFDLLPRIKKIRPD

SEQ ID NO: 22890 - protein, 17 aa, Brucella spp.
FAILIGITPITPDRTVT

SEQ ID NO: 22891 - protein, 17 aa, Brucella spp.
LEEAIGLARAIGLDIEH

SEQ ID NO: 22892 - protein, 17 aa, Brucella spp.
LTLETGIAHYWSRSRKT

SEQ ID NO: 22893 - protein, 17 aa, Brucella spp.
VGEKLVLHIDWQRRYKL

SEQ ID NO: 22894 - protein, 17 aa, Brucella spp.
LEQALDIDFGDDIYIDM

SEQ ID NO: 22895 - protein, 17 aa, Brucella spp.
TAISVAWAAGGVAISKA

SEQ ID NO: 22896 - protein, 17 aa, Brucella spp.
RTLARAVELETLVQSEV

SEQ ID NO: 22897 - protein, 17 aa, Brucella spp.
RRLYTLKGQQTFDDIKR

SEQ ID NO: 22898 - protein, 17 aa, Brucella spp.
KGAFPFILHCFSSGRAL

SEQ ID NO: 22899 - protein, 17 aa, Brucella spp.
EYIELGLFPSLAAAKKL

SEQ ID NO: 22900 - protein, 17 aa, Brucella spp.
YEFRNFEGLFLRRTEAT

SEQ ID NO: 22901 - protein, 17 aa, Brucella spp.
IRLACNALYRHFFTHNR

SEQ ID NO: 22902 - protein, 17 aa, Brucella spp.
NEARGLLIKAFIAEIIE

SEQ ID NO: 22903 - protein, 17 aa, Brucella spp.
NGILRLDILRGLLAAHD

SEQ ID NO: 22904 - protein, 17 aa, Brucella spp.
WVLKNLFGGTLQDSRID

SEQ ID NO: 22905 - protein, 17 aa, Brucella spp.
WASMLLRMYTRWAERNG

SEQ ID NO: 22906 - protein, 17 aa, Brucella spp.
VPQGMGVILRTAGANRT

SEQ ID NO: 22907 - protein, 17 aa, Brucella spp.
LEFDQAFVDALAAKLPE

SEQ ID NO: 22908 - protein, 17 aa, Brucella spp.
GKADFVFSLNYEVLPAI

SEQ ID NO: 22909 - protein, 17 aa, Brucella spp.
SILPFILIFVIMYFLII

SEQ ID NO: 22910 - protein, 17 aa, Brucella spp.
AGWPEGVLLNLNFPNCA

SEQ ID NO: 22911 - protein, 17 aa, Brucella spp.
HFVKVGSGWAFRTAPDL

SEQ ID NO: 22912 - protein, 17 aa, Brucella spp.
FSLEDDFTFEAEPETAA

SEQ ID NO: 22913 - protein, 17 aa, Brucella spp.
LEDDFTFEAEPETAAAA

SEQ ID NO: 22914 - protein, 17 aa, Brucella spp.
FGSHPLVKLVSLMDHAP

SEQ ID NO: 22915 - protein, 17 aa, Brucella spp.
LELQSISSFFALVPEEP

SEQ ID NO: 22916 - protein, 17 aa, Brucella spp.
EGHPAPLVIGYRDFADY

SEQ ID NO: 22917 - protein, 17 aa, Brucella spp.
TKFRIWFEIEAYACEAL

SEQ ID NO: 22918 - protein, 17 aa, Brucella spp.
LPFPTIMVVSRNDPFSS

SEQ ID NO: 22919 - protein, 17 aa, Brucella spp.
DVDLILIPGGFSYGDYL

SEQ ID NO: 22920 - protein, 17 aa, Brucella spp.
VGFVYQFHHLLPEFSAL

SEQ ID NO: 22921 - protein, 17 aa, Brucella spp.
FGFLLGIFSVFALFQSV

SEQ ID NO: 22922 - protein, 17 aa, Brucella spp.
FLAMILLVVYVGAVAVL

SEQ ID NO: 22923 - protein, 17 aa, Brucella spp.
WLCLFPMFVVFFISALA

SEQ ID NO: 22924 - protein, 17 aa, Brucella spp.
FPTGLKWSFMPKQSDGR

SEQ ID NO: 22925 - protein, 17 aa, Brucella spp.
TGLKWSFMPKQSDGRPH

SEQ ID NO: 22926 - protein, 17 aa, Brucella spp.
MPLIRVLEVATFYTQFQ

SEQ ID NO: 22927 - protein, 17 aa, Brucella spp.
FSRGWFIIWAVSAFGVL

SEQ ID NO: 22928 - protein, 17 aa, Brucella spp.
RGWFIIWAVSAFGVLVI

SEQ ID NO: 22929 - protein, 17 aa, Brucella spp.
YEMLSLHIFLALHRMKG

SEQ ID NO: 22930 - protein, 17 aa, Brucella spp.
VILKLALSADGMIGRKG

SEQ ID NO: 22931 - protein, 17 aa, Brucella spp.
LPPEASLIVQLVDMSVA

SEQ ID NO: 22932 - protein, 17 aa, Brucella spp.
IEMGKLMLLDESDKEIA

SEQ ID NO: 22933 - protein, 17 aa, Brucella spp.
MEGLLRFYAEAGVDVPL

SEQ ID NO: 22934 - protein, 17 aa, Brucella spp.
QKRFAWRDFLAVKLKLA

SEQ ID NO: 22935 - protein, 17 aa, Brucella spp.
LIAAISLLVFMSTVWVE

SEQ ID NO: 22936 - protein, 17 aa, Brucella spp.
FNAQTALLWGFPVIILL

SEQ ID NO: 22937 - protein, 17 aa, Brucella spp.
LLWGFPVIILLIGGGAL

SEQ ID NO: 22938 - protein, 17 aa, Brucella spp.
VVFEGIPPDLFREGQGV

SEQ ID NO: 22939 - protein, 17 aa, Brucella spp.
AGAEWVSGMALGLPPFA

SEQ ID NO: 22940 - protein, 17 aa, Brucella spp.
LGFGFAMKCDDGATRAS

SEQ ID NO: 22941 - protein, 17 aa, Brucella spp.
YDYDVATVYGFLKRYGL

SEQ ID NO: 22942 - protein, 17 aa, Brucella spp.
VATVYGFLKRYGLENEV

SEQ ID NO: 22943 - protein, 17 aa, Brucella spp.
HELALARTLGIFGSIDM

SEQ ID NO: 22944 - protein, 17 aa, Brucella spp.
LALARTLGIFGSIDMNR

SEQ ID NO: 22945 - protein, 17 aa, Brucella spp.
TDVEISFVCDLVRSYFS

SEQ ID NO: 22946 - protein, 17 aa, Brucella spp.
SLFPVFATVLLASLAGC

SEQ ID NO: 22947 - protein, 17 aa, Brucella spp.
NDMPLAIDILSDILTAS

SEQ ID NO: 22948 - protein, 17 aa, Brucella spp.
AQIAFPAPVRFAGDEEG

SEQ ID NO: 22949 - protein, 17 aa, Brucella spp.
TVPEGLTVKQVFDRIAA

SEQ ID NO: 22950 - protein, 17 aa, Brucella spp.
WGGMGLYLARHLKANVT

SEQ ID NO: 22951 - protein, 17 aa, Brucella spp.
RTLGFLFGAARGVLLVV

SEQ ID NO: 22952 - protein, 17 aa, Brucella spp.
LAVAMVLLAAFLDGIDG

SEQ ID NO: 22953 - protein, 17 aa, Brucella spp.
LLVKPLFEAGREAIGKG

SEQ ID NO: 22954 - protein, 17 aa, Brucella spp.
EPFKLFAEWLADAAKSE

SEQ ID NO: 22955 - protein, 17 aa, Brucella spp.
RADAILIFAIRHGRERP

SEQ ID NO: 22956 - protein, 17 aa, Brucella spp.
IGITMAFHRVKPPKPKA

SEQ ID NO: 22957 - protein, 17 aa, Brucella spp.
WYVDIWLTIVWVAYLVV

SEQ ID NO: 22958 - protein, 17 aa, Brucella spp.
GLVEIAPLFYLENTIEK

SEQ ID NO: 22959 - protein, 17 aa, Brucella spp.
NLLEWLNTYTFVAEQKF

SEQ ID NO: 22960 - protein, 17 aa, Brucella spp.
ALTPVKFGISFTKTESN

SEQ ID NO: 22961 - protein, 17 aa, Brucella spp.
TLAKAFGALGGYITGSR

SEQ ID NO: 22962 - protein, 17 aa, Brucella spp.
DVLSAAGLPVMPSQTHI

SEQ ID NO: 22963 - protein, 17 aa, Brucella spp.
TEFTGTIGLPMPSTDVV

SEQ ID NO: 22964 - protein, 17 aa, Brucella spp.
FTGTIGLPMPSTDVVIR

SEQ ID NO: 22965 - protein, 17 aa, Brucella spp.
AELPGQAALHFLIPMLK

SEQ ID NO: 22966 - protein, 17 aa, Brucella spp.
FETFSLINFNRAFPLLP

SEQ ID NO: 22967 - protein, 17 aa, Brucella spp.
DQAIEWVRRLAFANPFF

SEQ ID NO: 22968 - protein, 17 aa, Brucella spp.
WVRRLAFANPFFIEEPT

SEQ ID NO: 22969 - protein, 17 aa, Brucella spp.
IGIAWDWDAVRSRSIGE

SEQ ID NO: 22970 - protein, 17 aa, Brucella spp.
ETPAFWMTFKCAVMNLP

SEQ ID NO: 22971 - protein, 17 aa, Brucella spp.
ARWPEDIKVSVNLSPVQ

SEQ ID NO: 22972 - protein, 17 aa, Brucella spp.
WPEDIKVSVNLSPVQFD

SEQ ID NO: 22973 - protein, 17 aa, Brucella spp.
IIFAIPYEDDFTLIGTT

SEQ ID NO: 22974 - protein, 17 aa, Brucella spp.
YSLRHARPFTIGLNCAL

SEQ ID NO: 22975 - protein, 17 aa, Brucella spp.
LRHARPFTIGLNCALGA

SEQ ID NO: 22976 - protein, 17 aa, Brucella spp.
MKQAVAVLLPFMEEEKR

SEQ ID NO: 22977 - protein, 17 aa, Brucella spp.
EGFDIPLLIGGATTSRV

SEQ ID NO: 22978 - protein, 17 aa, Brucella spp.
FDIPLLIGGATTSRVHT

SEQ ID NO: 22979 - protein, 17 aa, Brucella spp.
ESLKGIDATLVFYESPN

SEQ ID NO: 22980 - protein, 17 aa, Brucella spp.
SDIDLLFLLPYKQTPWG

SEQ ID NO: 22981 - protein, 17 aa, Brucella spp.
VEVAMWWNDSYHEKVLC

SEQ ID NO: 22982 - protein, 17 aa, Brucella spp.
FCNMLWKLLKDARNTDV

SEQ ID NO: 22983 - protein, 17 aa, Brucella spp.
THFAVIFDYSSKTFRKE

SEQ ID NO: 22984 - protein, 17 aa, Brucella spp.
RSITKIFHFGRFDLAVL

SEQ ID NO: 22985 - protein, 17 aa, Brucella spp.
LMLQMIWGLYPRVDATF

SEQ ID NO: 22986 - protein, 17 aa, Brucella spp.
MAIAGLAIFFPLAAESH

SEQ ID NO: 22987 - protein, 17 aa, Brucella spp.
FNFAPRFLVSLEGLHAA

SEQ ID NO: 22988 - protein, 17 aa, Brucella spp.
AFFVFVVAAAVFAWPEQ

SEQ ID NO: 22989 - protein, 17 aa, Brucella spp.
SLPELPISINLEQLDVA

SEQ ID NO: 22990 - protein, 17 aa, Brucella spp.
STIDGFGVTSYWMHRNL

SEQ ID NO: 22991 - protein, 17 aa, Brucella spp.
WLVGFMLAFMPLYVLGL

SEQ ID NO: 22992 - protein, 17 aa, Brucella spp.
MAMPVNVPVNFKLTSSN

SEQ ID NO: 22993 - protein, 17 aa, Brucella spp.
KPVLVLLDAHRGEIYAQ

SEQ ID NO: 22994 - protein, 17 aa, Brucella spp.
FFFGTVWDPRFAAAGSG

SEQ ID NO: 22995 - protein, 17 aa, Brucella spp.
IRLVEYLVAEFKKESGI

SEQ ID NO: 22996 - protein, 17 aa, Brucella spp.
LHRIVGLFRFTIAPLRL

SEQ ID NO: 22997 - protein, 17 aa, Brucella spp.
MPAQPLLMACVWELGII

SEQ ID NO: 22998 - protein, 17 aa, Brucella spp.
ESYDIGAVLRFLSAIKA

SEQ ID NO: 22999 - protein, 17 aa, Brucella spp.
FSILALVFPFVWLLMQR

SEQ ID NO: 23000 - protein, 17 aa, Brucella spp.
LVFPFVWLLMQRLWFEA

SEQ ID NO: 23001 - protein, 17 aa, Brucella spp.
NRFSAVFFQPFYAGQTF

SEQ ID NO: 23002 - protein, 17 aa, Brucella spp.
AAHPWGIKITRVEIKDI

SEQ ID NO: 23003 - protein, 17 aa, Brucella spp.
LSVWPYWATKMRTSSSQ

SEQ ID NO: 23004 - protein, 17 aa, Brucella spp.
ATEPFHMQVFIGRSPML

SEQ ID NO: 23005 - protein, 17 aa, Brucella spp.
KAKGLDFSRIFYKPEAE

SEQ ID NO: 23006 - protein, 17 aa, Brucella spp.
PIGEMVGLVPLPWAYFP

SEQ ID NO: 23007 - protein, 17 aa, Brucella spp.
GEMVGLVPLPWAYFPWL

SEQ ID NO: 23008 - protein, 17 aa, Brucella spp.
LSNELDLFYGVEFRKRF

SEQ ID NO: 23009 - protein, 17 aa, Brucella spp.
PVAVFGLPQNLLSLASA

SEQ ID NO: 23010 - protein, 17 aa, Brucella spp.
FSEPMVFDAAAGISSSS

SEQ ID NO: 23011 - protein, 17 aa, Brucella spp.
FPADWRWPQHINGQPMD

SEQ ID NO: 23012 - protein, 17 aa, Brucella spp.
LLKEISLLLCYEVTRNL

SEQ ID NO: 23013 - protein, 17 aa, Brucella spp.
KEISLLLCYEVTRNLEL

SEQ ID NO: 23014 - protein, 17 aa, Brucella spp.
SEWNLKNLFTGWRDPGL

SEQ ID NO: 23015 - protein, 17 aa, Brucella spp.
HLMKLGLDFYNDTRSGH

SEQ ID NO: 23016 - protein, 17 aa, Brucella spp.
QSFKFPVLVGDIGGTNA

SEQ ID NO: 23017 - protein, 17 aa, Brucella spp.
MIVSMPWWAARLQASIL

SEQ ID NO: 23018 - protein, 17 aa, Brucella spp.
LKKAVLLSFRLNPMEVI

SEQ ID NO: 23019 - protein, 17 aa, Brucella spp.
KAVLLSFRLNPMEVIKG

SEQ ID NO: 23020 - protein, 17 aa, Brucella spp.
GMLLSLVAIMIFFHIVT

SEQ ID NO: 23021 - protein, 17 aa, Brucella spp.
WSWREIMYKFALTMTPE

SEQ ID NO: 23022 - protein, 17 aa, Brucella spp.
EVIEGLDILILRELTGG

SEQ ID NO: 23023 - protein, 17 aa, Brucella spp.
LDVALSIALPGIDKAKA

SEQ ID NO: 23024 - protein, 17 aa, Brucella spp.
RAGEIVCIYGLMGAGRT

SEQ ID NO: 23025 - protein, 17 aa, Brucella spp.
LLEGRAFFALIAIIAVF

SEQ ID NO: 23026 - protein, 17 aa, Brucella spp.
IPVVGAPLFIISHPALV

SEQ ID NO: 23027 - protein, 17 aa, Brucella spp.
LCVKYKVPIVISSLGAV

SEQ ID NO: 23028 - protein, 17 aa, Brucella spp.
EEPGGAKWINIFLPDEA

SEQ ID NO: 23029 - protein, 17 aa, Brucella spp.
FLFDMDFSASRKPGGAG

SEQ ID NO: 23030 - protein, 17 aa, Brucella spp.
KPILFAIGAVMIAIAGL

SEQ ID NO: 23031 - protein, 17 aa, Brucella spp.
AKWYQLAADQGFAPAQY

SEQ ID NO: 23032 - protein, 17 aa, Brucella spp.
FELMKLRLLNGSHSTLA

SEQ ID NO: 23033 - protein, 17 aa, Brucella spp.
LILAFAFVSVAFVSGAH

SEQ ID NO: 23034 - protein, 17 aa, Brucella spp.
KNFIGIHFFSPVDKMML

SEQ ID NO: 23035 - protein, 17 aa, Brucella spp.
PDFGMRWAALGVDFEMF

SEQ ID NO: 23036 - protein, 17 aa, Brucella spp.
ADLPVTFALMLNLVSAS

SEQ ID NO: 23037 - protein, 17 aa, Brucella spp.
LPVTFALMLNLVSASNA

SEQ ID NO: 23038 - protein, 17 aa, Brucella spp.
IANWRWAGVPFYLRTGK

SEQ ID NO: 23039 - protein, 17 aa, Brucella spp.
PDLAGWDGIGFVVQAYG

SEQ ID NO: 23040 - protein, 17 aa, Brucella spp.
SALPWDHPLNFGPVGVT

SEQ ID NO: 23041 - protein, 17 aa, Brucella spp.
LPWDHPLNFGPVGVTGA

SEQ ID NO: 23042 - protein, 17 aa, Brucella spp.
WDHPLNFGPVGVTGADS

SEQ ID NO: 23043 - protein, 17 aa, Brucella spp.
MGYEIAGGLGIKMAEPD

SEQ ID NO: 23044 - protein, 17 aa, Brucella spp.
MAHPFHIHGASFRILSM

SEQ ID NO: 23045 - protein, 17 aa, Brucella spp.
LAALLRFMSGAFNQATR

SEQ ID NO: 23046 - protein, 17 aa, Brucella spp.
MGAPIKLARESQAAAGL

SEQ ID NO: 23047 - protein, 17 aa, Brucella spp.
LITPWNWPMNQITLKVI

SEQ ID NO: 23048 - protein, 17 aa, Brucella spp.
LSLGMRWFPVVGWAERG

SEQ ID NO: 23049 - protein, 17 aa, Brucella spp.
MHMPLLLTRAIERKQPL

SEQ ID NO: 23050 - protein, 17 aa, Brucella spp.
TVLKPLWNAYAVLKRGR

SEQ ID NO: 23051 - protein, 17 aa, Brucella spp.
EVFSVGLNRAVSVLADK

SEQ ID NO: 23052 - protein, 17 aa, Brucella spp.
VEWAVAWFGGDGFVHSY

SEQ ID NO: 23053 - protein, 17 aa, Brucella spp.
PDLPVLHLPAWDCLPYD

SEQ ID NO: 23054 - protein, 17 aa, Brucella spp.
RMVGMLFSLYFEQGQDI

SEQ ID NO: 23055 - protein, 17 aa, Brucella spp.
LHHLGILALTNFGRAGD

SEQ ID NO: 23056 - protein, 17 aa, Brucella spp.
LVIGYILRHHLSWMRLI

SEQ ID NO: 23057 - protein, 17 aa, Brucella spp.
THFAVRIPWVMGLIGTR

SEQ ID NO: 23058 - protein, 17 aa, Brucella spp.
AALLWGVIMTFCSMLPA

SEQ ID NO: 23059 - protein, 17 aa, Brucella spp.
HCGWPSFTKPIERANVT

SEQ ID NO: 23060 - protein, 17 aa, Brucella spp.
DGRSFTIFISYRAPDPV

SEQ ID NO: 23061 - protein, 17 aa, Brucella spp.
ETVELPFRVAGIDTASL

SEQ ID NO: 23062 - protein, 17 aa, Brucella spp.
QAVGVPLLGLRGISDGA

SEQ ID NO: 23063 - protein, 17 aa, Brucella spp.
ALNWKTSIVDLIKALGL

SEQ ID NO: 23064 - protein, 17 aa, Brucella spp.
LKKSFDWVICDSPAGIE

SEQ ID NO: 23065 - protein, 17 aa, Brucella spp.
LFYSGFYLPMYWSSRAK

SEQ ID NO: 23066 - protein, 17 aa, Brucella spp.
KDFAFELLLELYDNEVR

SEQ ID NO: 23067 - protein, 17 aa, Brucella spp.
VDQGLSLTLFFRDTATT

SEQ ID NO: 23068 - protein, 17 aa, Brucella spp.
SDLPFTFLVEPGKPRIS

SEQ ID NO: 23069 - protein, 17 aa, Brucella spp.
LFLPFLLFIAAREIIAG

SEQ ID NO: 23070 - protein, 17 aa, Brucella spp.
GNLLLRWHRLGPDLYET

SEQ ID NO: 23071 - protein, 17 aa, Brucella spp.
GYLLFILVWLGFYNHAQ

SEQ ID NO: 23072 - protein, 17 aa, Brucella spp.
KPETFAAAWQFFDLTDF

SEQ ID NO: 23073 - protein, 17 aa, Brucella spp.
VAESVMFMLTRPRNITI

SEQ ID NO: 23074 - protein, 17 aa, Brucella spp.
VPWMFALFVALVIAMNY

SEQ ID NO: 23075 - protein, 17 aa, Brucella spp.
TDEQWAFAAGTRFADDA

SEQ ID NO: 23076 - protein, 17 aa, Brucella spp.
ADVYLLRGFADIFSTGI

SEQ ID NO: 23077 - protein, 17 aa, Brucella spp.
ADMQALFFAGGYEGRVK

SEQ ID NO: 23078 - protein, 17 aa, Brucella spp.
FRLALKLAKLGKPFASL

SEQ ID NO: 23079 - protein, 17 aa, Brucella spp.
FIIILGAALGTFFVANP

SEQ ID NO: 23080 - protein, 17 aa, Brucella spp.
PVLKAFIEKAGRLRDKI

SEQ ID NO: 23081 - protein, 25 aa, Brucella spp.
AMRKQELMFAILKKLAAQDVEIIGE

SEQ ID NO: 23082 - protein, 25 aa, Brucella spp.
ITANHPECYLIVLLIDERPEEVTDM

SEQ ID NO: 23083 - protein, 28 aa, Brucella spp.
PRADLQKIFVLRRILAPMGTTDAIEFLI

SEQ ID NO: 23084 - protein, 23 aa, Brucella spp.
PKTRFVYETICQAIPEPRHAALL

SEQ ID NO: 23085 - protein, 28 aa, Brucella spp.
GDAIDRGLTLFFPAPHSFTGEDCAEFHL

SEQ ID NO: 23086 - protein, 19 aa, Brucella spp.
RKLYSEWRQRLINARAFIE

SEQ ID NO: 23087 - protein, 17 aa, Brucella spp.
SVSMQVWQQLSALKHEI

SEQ ID NO: 23088 - protein, 18 aa, Brucella spp.
QVWQQLSALKHEIEHHIA

SEQ ID NO: 23089 - protein, 23 aa, Brucella spp.
TTRDLLEVKLDLGGIPVYVTDTA

SEQ ID NO: 23090 - protein, 26 aa, Brucella spp.
ALGLSERLLSFGFTLGRLKTGTPPRL

SEQ ID NO: 23091 - protein, 18 aa, Brucella spp.
LEKAVLLQPGYAIEYDFI

SEQ ID NO: 23092 - protein, 18 aa, Brucella spp.
GSEPVILQRTEAYIGVMV

SEQ ID NO: 23093 - protein, 20 aa, Brucella spp.
PVILQRTEAYIGVMVDDLTS

SEQ ID NO: 23094 - protein, 23 aa, Brucella spp.
VSEPYRMFTSRAEFRLSLRADNA

SEQ ID NO: 23095 - protein, 37 aa, Brucella spp.
RSAYDLLSYPDINLDRLIAIWPELASIDPVTREALEI

SEQ ID NO: 23096 - protein, 28 aa, Brucella spp.
AMQTDVPNLFIVPSTLDLLGIEMEIAQS

SEQ ID NO: 23097 - protein, 24 aa, Brucella spp.
VSERFTYVLVDCPPSLNLLTLNAM

SEQ ID NO: 23098 - protein, 25 aa, Brucella spp.
SVLVPLQCEFFALEGLGQLLQTVDQ

SEQ ID NO: 23099 - protein, 17 aa, Brucella spp.
TSSFPVVLLYGPDKGLV

SEQ ID NO: 23100 - protein, 25 aa, Brucella spp.
MFGGQRLIWIKNAGGQKKLAEAVKR

SEQ ID NO: 23101 - protein, 27 aa, Brucella spp.
VVKSGTAPFLLLTAAMRQFQQVQALRH

SEQ ID NO: 23102 - protein, 26 aa, Brucella spp.
VASARPPIFFNRKKLIETAISRWTGE

SEQ ID NO: 23103 - protein, 24 aa, Brucella spp.
AALSVPIIRQCLLAISVESLRNAR

SEQ ID NO: 23104 - protein, 28 aa, Brucella spp.
DGAYFRVHHFARQLASPFPLLAAIGAKT

SEQ ID NO: 23105 - protein, 19 aa, Brucella spp.
DMRYENPFYMVEDAGAADL

SEQ ID NO: 23106 - protein, 26 aa, Brucella spp.
AQPNPRPMFPNPPGLLRIEPHSDGLR

SEQ ID NO: 23107 - protein, 20 aa, Brucella spp.
DGLRDRIWWGAGSNATAQWA

SEQ ID NO: 23108 - protein, 27 aa, Brucella spp.
SSAEPPLIWQMITNNEIPAYNIPSGIL

SEQ ID NO: 23109 - protein, 28 aa, Brucella spp.
VSFEGEDWLYFPAIAPQVAIIRATTADE

SEQ ID NO: 23110 - protein, 25 aa, Brucella spp.
AISGEIFRPLDTFRLPEFNIQKAIA

SEQ ID NO: 23111 - protein, 22 aa, Brucella spp.
AYMPSPYQFTYFQGAGFDASLL

SEQ ID NO: 23112 - protein, 18 aa, Brucella spp.
HILDQAEFPLIVSDQLKL

SEQ ID NO: 23113 - protein, 30 aa, Brucella spp.
NRDPRAIFQRGFFRPKELWYETSGAPFNPG

SEQ ID NO: 23114 - protein, 23 aa, Brucella spp.
GEALVLRPKLVILSAGAVQSAAL

SEQ ID NO: 23115 - protein, 24 aa, Brucella spp.
MRHVPEWLLNRIAGHTIDFYAMSE

SEQ ID NO: 23116 - protein, 31 aa, Brucella spp.
SVDGDRIILHWVRSNWKEHLMLVEKLKSALR

SEQ ID NO: 23117 - protein, 24 aa, Brucella spp.
SSGDKVFFSQTFDIGVANTGATDI

SEQ ID NO: 23118 - protein, 25 aa, Brucella spp.
DINLDKVCFIALGDKGKTFNADTID

SEQ ID NO: 23119 - protein, 32 aa, Brucella spp.
QPHRTIDPILAGSQLMIALQGIVSRNTDPLDS

SEQ ID NO: 23120 - protein, 33 aa, Brucella spp.
MAAEDFSYMLEARPGAYIFLGNGDTPGLHHPAY

SEQ ID NO: 23121 - protein, 28 aa, Brucella spp.
PDRPHCLEYIDRLFTEFTPLAGDRKFAN

SEQ ID NO: 23122 - protein, 32 aa, Brucella spp.
AVRIMEMADRFQLPLITFVDTAGAYPGVSAEE

SEQ ID NO: 23123 - protein, 18 aa, Brucella spp.
ECLKLRVPVISIIIGEGG

SEQ ID NO: 23124 - protein, 25 aa, Brucella spp.
IAVANRVYMLEHSIYSVISPEGAAS

SEQ ID NO: 23125 - protein, 23 aa, Brucella spp.
TAQDLFDLKIIDGIIPEPLGGAH

SEQ ID NO: 23126 - protein, 29 aa, Brucella spp.
ARRLSALRQFFRFLYSEGFRQDDPTGILY

SEQ ID NO: 23127 - protein, 21 aa, Brucella spp.
IKALRLHALLETLYATGLRVS

SEQ ID NO: 23128 - protein, 25 aa, Brucella spp.
GSDDNPWLFPAFSESGHLARQVFAR

SEQ ID NO: 23129 - protein, 26 aa, Brucella spp.
RDLERRVILRLLDDGPMVLATGGGAY

SEQ ID NO: 23130 - protein, 26 aa, Brucella spp.
QRLMDERYPVYALAELHLMTRDEKKE

SEQ ID NO: 23131 - protein, 25 aa, Brucella spp.
GIVRRGMNFVQMPTSLLAQVDSSVG

SEQ ID NO: 23132 - protein, 32 aa, Brucella spp.
EVAKYGLIDRPDFFAWLEANWQEVFSGGAART

SEQ ID NO: 23133 - protein, 26 aa, Brucella spp.
VTRGTLTFILTHGIGQSFIAKDVPPA

SEQ ID NO: 23134 - protein, 27 aa, Brucella spp.
DGAGETHFRIRIVAEAFTGMSRVQRHR

SEQ ID NO: 23135 - protein, 25 aa, Brucella spp.
MREGEYLHFCIDHVREYNKNFNYFS

SEQ ID NO: 23136 - protein, 19 aa, Brucella spp.
REYNKNFNYFSGLSDGDIA

SEQ ID NO: 23137 - protein, 19 aa, Brucella spp.
KPRTLELKALATLGLDANS

SEQ ID NO: 23138 - protein, 26 aa, Brucella spp.
PELDPDYLFDRQTTLAILAGFAYNRR

SEQ ID NO: 23139 - protein, 26 aa, Brucella spp.
EFKDGILPWAYQHNVALVFDEYDAGR

SEQ ID NO: 23140 - protein, 23 aa, Brucella spp.
GRPDVMFVIQRVLESSGRLTLLD

SEQ ID NO: 23141 - protein, 30 aa, Brucella spp.
LLDQSRVIRPHPAFRLFATANTVGLGDTTG

SEQ ID NO: 23142 - protein, 21 aa, Brucella spp.
QMDRWSIVTTLNYLPHDNEVN

SEQ ID NO: 23143 - protein, 17 aa, Brucella spp.
FNDVGFAFRLTFLNKCD

SEQ ID NO: 23144 - protein, 26 aa, Brucella spp.
EAGQVLELWRDWIEQKASADIARLGE

SEQ ID NO: 23145 - protein, 17 aa, Brucella spp.
DRLRGFLDKQLANLQGV

SEQ ID NO: 23146 - protein, 27 aa, Brucella spp.
YLDSARLVRIVIDPTQPLSYKQERDTD

SEQ ID NO: 23147 - protein, 24 aa, Brucella spp.
RLNDLRHIVYKSADAPWRRARRNL

SEQ ID NO: 23148 - protein, 25 aa, Brucella spp.
RARRNLGLMMREGLLKENIDGEALI

SEQ ID NO: 23149 - protein, 28 aa, Brucella spp.
NIDGEALIWAHQRLLGRPEQRKILMMIS

SEQ ID NO: 23150 - protein, 27 aa, Brucella spp.
GRPEQRKILMMISDGAPVDDSTLSVNP

SEQ ID NO: 23151 - protein, 20 aa, Brucella spp.
VAFVLNGQIFTVAASARILG

SEQ ID NO: 23152 - protein, 33 aa, Brucella spp.
INNQGTIARLFPSIPELFSVDANVVPAIYVRGD

SEQ ID NO: 23153 - protein, 29 aa, Brucella spp.
YVRGDRNYIINSHIILGNATINNGQFAST

SEQ ID NO: 23154 - protein, 21 aa, Brucella spp.
RQQMGYMGFVDFVKNGTSTWS

SEQ ID NO: 23155 - protein, 17 aa, Brucella spp.
IFNRSDSFTYDKVISGT

SEQ ID NO: 23156 - protein, 27 aa, Brucella spp.
MGDFGPGLYRLFDFGGTRSGNLTLGSV

SEQ ID NO: 23157 - protein, 38 aa, Brucella spp.
TGTDPSLLQLITTTPNQYNLFFGGQPGFNIWDGGNSAD

SEQ ID NO: 23158 - protein, 17 aa, Brucella spp.
QASGLVFSTDGYLLTGS

SEQ ID NO: 23159 - protein, 20 aa, Brucella spp.
SGLVFSTDGYLLTGSSIILD

SEQ ID NO: 23160 - protein, 24 aa, Brucella spp.
DNLDGDWYLRSQLKDTPTPTPTPQ

SEQ ID NO: 23161 - protein, 26 aa, Brucella spp.
SVTPQAQLMWSKLSMDTFNNIWEANV

SEQ ID NO: 23162 - protein, 29 aa, Brucella spp.
DDAGQIVHTNIYVIANIYQEFMGNGRVGV

SEQ ID NO: 23163 - protein, 25 aa, Brucella spp.
AWADNKYLIYGEGAINTSLNNFADS

SEQ ID NO: 23164 - protein, 25 aa, Brucella spp.
KPGTDRFTFIFASNPNGNVKVASGS

SEQ ID NO: 23165 - protein, 23 aa, Brucella spp.
SATSFSILPSVSFPVITRNPSPA

SEQ ID NO: 23166 - protein, 26 aa, Brucella spp.
IRGASAFVYIFDTAFGTELEAPDTDI

SEQ ID NO: 23167 - protein, 26 aa, Brucella spp.
KNTSPNEFIALFLNNKFQNQIAGTNL

SEQ ID NO: 23168 - protein, 22 aa, Brucella spp.
KPQNNFLYTIRTSNGDLINSKT

SEQ ID NO: 23169 - protein, 26 aa, Brucella spp.
LINSKTTLLQLFGPLPTPNPENQILG

SEQ ID NO: 23170 - protein, 26 aa, Brucella spp.
PTDSAFNIIIPFDDISGYGTPKDPKR

SEQ ID NO: 23171 - protein, 24 aa, Brucella spp.
RSNLYKMYYEITPASATTPIAASS

SEQ ID NO: 23172 - protein, 23 aa, Brucella spp.
TQSPPVLYLNIVNGSVVATCAPW

SEQ ID NO: 23173 - protein, 17 aa, Brucella spp.
LLLNDVVIDSQPIEAQD

SEQ ID NO: 23174 - protein, 25 aa, Brucella spp.
GYTDDYPYLMPANIAVIQGPPNMQL

SEQ ID NO: 23175 - protein, 24 aa, Brucella spp.
ADVCNFYFDENGVAPLVLIRIDKL

SEQ ID NO: 23176 - protein, 25 aa, Brucella spp.
IADGNTICIISIVFNKRYIDTSSDD

SEQ ID NO: 23177 - protein, 26 aa, Brucella spp.
TSSDDTIFIVIPDSLSLSKNMFNKNF

SEQ ID NO: 23178 - protein, 23 aa, Brucella spp.
GTYKVSFFPSKSALAYFSKDILF

SEQ ID NO: 23179 - protein, 28 aa, Brucella spp.
AGKTSLMRLLFMALKPTRGLINIFGKDV

SEQ ID NO: 23180 - protein, 30 aa, Brucella spp.
KKAGALIVDRFLYTPMTYPGNYGFVPHTLS

SEQ ID NO: 23181 - protein, 19 aa, Brucella spp.
VFGYGSLMWRPGFAHVETV

SEQ ID NO: 23182 - protein, 24 aa, Brucella spp.
QETLKEMWRVLAPNGRLVIVVPNR

SEQ ID NO: 23183 - protein, 26 aa, Brucella spp.
PPASRRWMMRPCLALESMGRRLWPLF

SEQ ID NO: 23184 - protein, 28 aa, Brucella spp.
ALESMGRRLWPLFAGVLIIEAQKRLYQG

SEQ ID NO: 23185 - protein, 32 aa, Brucella spp.
IAERKFHNLLTISILKGSFIFAADLIRAMHDA

SEQ ID NO: 23186 - protein, 21 aa, Brucella spp.
TPFYVYSRATIERHFRVFHDA

SEQ ID NO: 23187 - protein, 23 aa, Brucella spp.
TIERHFRVFHDAFADMDTLVTYA

SEQ ID NO: 23188 - protein, 26 aa, Brucella spp.
HIGSQIIDLEPFDNAFALMAELVKEL

SEQ ID NO: 23189 - protein, 17 aa, Brucella spp.
FVIVDAAMNDLIRPTLY

SEQ ID NO: 23190 - protein, 25 aa, Brucella spp.
AAMNDLIRPTLYDAFHDIRPVIMPN

SEQ ID NO: 23191 - protein, 22 aa, Brucella spp.
QVAVDFRLWVKQELEKTAAALK

SEQ ID NO: 23192 - protein, 18 aa, Brucella spp.
TFGHHCMAYVEMFGRDLS

SEQ ID NO: 23193 - protein, 28 aa, Brucella spp.
LSRLAEEIVIWSTPQFNFVRLSDAFSTG

SEQ ID NO: 23194 - protein, 17 aa, Brucella spp.
QFNFVRLSDAFSTGSSI

SEQ ID NO: 23195 - protein, 28 aa, Brucella spp.
RINGSLVALLTIMKGLPLAYSKDMQEDK

SEQ ID NO: 23196 - protein, 27 aa, Brucella spp.
TATDLADWLVRTLGLPFREAHHVTGRA

SEQ ID NO: 23197 - protein, 26 aa, Brucella spp.
LNANLQPLRSFILPGGSPASAALHLA

SEQ ID NO: 23198 - protein, 30 aa, Brucella spp.
KVSPEALQYINRLSDFLFVAGRAVNDNGAS

SEQ ID NO: 23199 - protein, 25 aa, Brucella spp.
GPRTVLKFVIFDEADYAYARTVSAR

SEQ ID NO: 23200 - protein, 19 aa, Brucella spp.
IMRRMEWLVDKVIADGWFE

SEQ ID NO: 23201 - protein, 29 aa, Brucella spp.
TAERLAKHFFDWCHARWPEISAVRSAKHR

SEQ ID NO: 23202 - protein, 17 aa, Brucella spp.
VFLGKQAIDDDSNQTGQ

SEQ ID NO: 23203 - protein, 26 aa, Brucella spp.
SNQTGQMLSALLNWSQATFASKVELG

SEQ ID NO: 23204 - protein, 34 aa, Brucella spp.
QTIDVKLPAIVTVDLRLNQPRYASLPNIMKAKKK

SEQ ID NO: 23205 - protein, 27 aa, Brucella spp.
ATTSAKNILPRVAALLDVMQLSEIMEV

SEQ ID NO: 23206 - protein, 20 aa, Brucella spp.
AEKFQEVILPVADKLGAAVG

SEQ ID NO: 23207 - protein, 22 aa, Brucella spp.
VVAPDLYIAVGISGAIQHLAGM

SEQ ID NO: 23208 - protein, 29 aa, Brucella spp.
GVKANLLVKLEFFNPLASVKDRIGLAMIE

SEQ ID NO: 23209 - protein, 24 aa, Brucella spp.
AAAKGYRLILTMPETMSMERRKLL

SEQ ID NO: 23210 - protein, 26 aa, Brucella spp.
MSMERRKLLRLLGAELVLTEGAKGMK

SEQ ID NO: 23211 - protein, 26 aa, Brucella spp.
NAGKNIVVVIPSFAERYLSTALFEGL

SEQ ID NO: 23212 - protein, 24 aa, Brucella spp.
GAVKPPVFLTSTFVFKTAEDGRDF

SEQ ID NO: 23213 - protein, 25 aa, Brucella spp.
SAIATTLFAFVRPGDVILHSQPLYG

SEQ ID NO: 23214 - protein, 25 aa, Brucella spp.
ETLLAKTFFNFGVEAVAFADGVHEA

SEQ ID NO: 23215 - protein, 23 aa, Brucella spp.
LDPHSCWMLGRSLETLGLRMERA

SEQ ID NO: 23216 - protein, 20 aa, Brucella spp.
KVEKLHYLPFADERSDIAAL

SEQ ID NO: 23217 - protein, 28 aa, Brucella spp.
KGGQAAAFRFLNALQILKLAVSLGGTES

SEQ ID NO: 23218 - protein, 20 aa, Brucella spp.
DGLLMEQFVVDVFQGGAGTS

SEQ ID NO: 23219 - protein, 19 aa, Brucella spp.
DVYPTAVRLALLLSQNQVQ

SEQ ID NO: 23220 - protein, 33 aa, Brucella spp.
ESGQLQLNAFEPLIVYNILSSMRLLGRAMTNLA

SEQ ID NO: 23221 - protein, 27 aa, Brucella spp.
LDASALTIMLDPLRMAFPPETHDKEAH

SEQ ID NO: 23222 - protein, 29 aa, Brucella spp.
AAKRVLGMRPFDVQLIGGMVLHERGIAEM

SEQ ID NO: 23223 - protein, 19 aa, Brucella spp.
LMATLPVYLNALEGKGVHV

SEQ ID NO: 23224 - protein, 26 aa, Brucella spp.
AETMGRLYNFLGLTVGVIKHGLDDDE

SEQ ID NO: 23225 - protein, 28 aa, Brucella spp.
LEDRSDFYNLIDTFIPPLAEEDYEVDEK

SEQ ID NO: 23226 - protein, 20 aa, Brucella spp.
IVRNDEIVIIDEFTGRMMPG

SEQ ID NO: 23227 - protein, 26 aa, Brucella spp.
ASITFQNYFRMYNKLSGMTGTAATEA

SEQ ID NO: 23228 - protein, 27 aa, Brucella spp.
GDPGRSKFFLSLQDDLMRIFGSDRMDG

SEQ ID NO: 23229 - protein, 23 aa, Brucella spp.
HEVIEDMVILRIPKDAYAEKWDI

SEQ ID NO: 23230 - protein, 26 aa, Brucella spp.
IMQSLDNLWREHLVNLDHLRSVVGFR

SEQ ID NO: 23231 - protein, 26 aa, Brucella spp.
YKTEAFELFQTMLANLREVVISQLMR

SEQ ID NO: 23232 - protein, 28 aa, Brucella spp.
KYKGRTDLMLMVFDRPAEAAGVFTRSLC

SEQ ID NO: 23233 - protein, 25 aa, Brucella spp.
IAPDMATMLSFVVTDAPIKADALQS

SEQ ID NO: 23234 - protein, 24 aa, Brucella spp.
STSDTLMLFATGTAAERGAPEITD

SEQ ID NO: 23235 - protein, 26 aa, Brucella spp.
PADRDRLAIWFGDIRVAHQGERDPAY

SEQ ID NO: 23236 - protein, 26 aa, Brucella spp.
VAPEPKLSWFERLRRGLARSSSSLSD

SEQ ID NO: 23237 - protein, 31 aa, Brucella spp.
VAKPLELDLSHKPHVILVVGVNGTGKTTTIG

SEQ ID NO: 23238 - protein, 18 aa, Brucella spp.
AIEQLHIWGERTGSPVVS

SEQ ID NO: 23239 - protein, 17 aa, Brucella spp.
HIWGERTGSPVVSSKLG

SEQ ID NO: 23240 - protein, 32 aa, Brucella spp.
GILVAISARHKLPIYFIGVGEGIDDLEPFAAK

SEQ ID NO: 23241 - protein, 25 aa, Brucella spp.
LKSNSYRMLPDFGVNQFEKVRVNDI

SEQ ID NO: 23242 - protein, 23 aa, Brucella spp.
GCDHRCTFCIIPYGRGNSRSVPM

SEQ ID NO: 23243 - protein, 27 aa, Brucella spp.
IASEKRLMPHLHLSLQAGDDMILKRMK

SEQ ID NO: 23244 - protein, 18 aa, Brucella spp.
MILKRMKRRHLRDDSIRF

SEQ ID NO: 23245 - protein, 29 aa, Brucella spp.
CQTARALRPDIVFGADIIAGFPTETEEMF

SEQ ID NO: 23246 - protein, 26 aa, Brucella spp.
IVEECGLTHLHVFPYSPREGTPAARM

SEQ ID NO: 23247 - protein, 26 aa, Brucella spp.
VDMGTPRFDWQDIPLAQAVADTRKIE

SEQ ID NO: 23248 - protein, 28 aa, Brucella spp.
SMGNPHAVFWVDKDVWSYELDKFGPLLE

SEQ ID NO: 23249 - protein, 18 aa, Brucella spp.
DVWSYELDKFGPLLENHP

SEQ ID NO: 23250 - protein, 24 aa, Brucella spp.
PLLENHPIFPERANISIAHVTSSD

SEQ ID NO: 23251 - protein, 26 aa, Brucella spp.
NVPGGPLLIEWRDDDHVMMTGPAEWE

SEQ ID NO: 23252 - protein, 24 aa, Brucella spp.
VAFLCQFQNYQVVSSILEGLWRQK

SEQ ID NO: 23253 - protein, 20 aa, Brucella spp.
KRLLHTYGAPIANGVAVYSV

SEQ ID NO: 23254 - protein, 25 aa, Brucella spp.
DIERELYLSILIDRSVGRPAFVVST

SEQ ID NO: 23255 - protein, 30 aa, Brucella spp.
GAREDGLKLFPILYKAFTEKDMSLLEINPL

SEQ ID NO: 23256 - protein, 26 aa, Brucella spp.
FTEKDMSLLEINPLIVMTNGRVRVLD

SEQ ID NO: 23257 - protein, 17 aa, Brucella spp.
VIYVPPAGAADAIIEAI

SEQ ID NO: 23258 - protein, 27 aa, Brucella spp.
AIEAEIGFIVCITEGIPVMDIVRVKER

SEQ ID NO: 23259 - protein, 28 aa, Brucella spp.
PVKGTEFIDVLEMFLADDETKSIVMIGE

SEQ ID NO: 23260 - protein, 22 aa, Brucella spp.
SVRAIMMIRAYRMRGHLHANLD

SEQ ID NO: 23261 - protein, 25 aa, Brucella spp.
ADYNRKIFIDNVLGLEYATVPEMLD

SEQ ID NO: 23262 - protein, 26 aa, Brucella spp.
HRVAGTLHFIINNQIGFTTNPAFSRS

SEQ ID NO: 23263 - protein, 28 aa, Brucella spp.
KVATEFRMTFHKPVVIDMFCYRRFGHNE

SEQ ID NO: 23264 - protein, 24 aa, Brucella spp.
SDPRALVLWEAQFGDFANGAQVVF

SEQ ID NO: 23265 - protein, 26 aa, Brucella spp.
SGERKWLRMSGLVCLLPHGFEGQGPE

SEQ ID NO: 23266 - protein, 28 aa, Brucella spp.
MKRDFRKPLIMMTPKSLLRHKRAISTLA

SEQ ID NO: 23267 - protein, 31 aa, Brucella spp.
KRGIDDVYLLRVEQLYPFPAKALINELSRFR

SEQ ID NO: 23268 - protein, 28 aa, Brucella spp.
PKNMGAWSFIDPYLEWVLAHIDAKHQRV

SEQ ID NO: 23269 - protein, 26 aa, Brucella spp.
KHGVKLGFMGFFTKAVTHALKEIPAV

SEQ ID NO: 23270 - protein, 19 aa, Brucella spp.
DIVYKNFCHVGMAVGTDKG

SEQ ID NO: 23271 - protein, 31 aa, Brucella spp.
MVVGGQIVVRPMMYLALSYDHRIVDGKEAVT

SEQ ID NO: 23272 - protein, 27 aa, Brucella spp.
ANVSGVEFLFKKNKITPYIGTGKIVGK

SEQ ID NO: 23273 - protein, 25 aa, Brucella spp.
EVSKQFQRLLEKQGIAFKLGAKVTG

SEQ ID NO: 23274 - protein, 19 aa, Brucella spp.
GHVNFDVIPSVVYTQPEVA

SEQ ID NO: 23275 - protein, 24 aa, Brucella spp.
NGRARAMLHTGGFVKILADKATDR

SEQ ID NO: 23276 - protein, 23 aa, Brucella spp.
YNAGEMIHELAVLMEFGGSSEDL

SEQ ID NO: 23277 - protein, 27 aa, Brucella spp.
YERDTRQFLQFLTGHLGEPPSLKEIGN

SEQ ID NO: 23278 - protein, 25 aa, Brucella spp.
AARNAAVLTLLYGCGLRISEALGLS

SEQ ID NO: 23279 - protein, 23 aa, Brucella spp.
SKTRLVPLLPAVHKAVAQYRALC

SEQ ID NO: 23280 - protein, 25 aa, Brucella spp.
VAQYRALCPFDLSAGQLLFRGAKGG

SEQ ID NO: 23281 - protein, 17 aa, Brucella spp.
LFRGAKGGPLHAAIIQR

SEQ ID NO: 23282 - protein, 27 aa, Brucella spp.
SEKGKRPMLIPFTEAAVPEIDFDKGII

SEQ ID NO: 23283 - protein, 29 aa, Brucella spp.
RFHASVLTLYPEMFPGPLGISLAGKALAE

SEQ ID NO: 23284 - protein, 25 aa, Brucella spp.
VDDGRPMLLMTPRGKPLTQERVRAL

SEQ ID NO: 23285 - protein, 17 aa, Brucella spp.
VLLDAVVRLLPGVMGNR

SEQ ID NO: 23286 - protein, 19 aa, Brucella spp.
FIRRESRLFVKLASAPHGD

SEQ ID NO: 23287 - protein, 19 aa, Brucella spp.
LDLAAELRPLLADLDGFIS

SEQ ID NO: 23288 - protein, 21 aa, Brucella spp.
AELRPLLADLDGFISIERFQS

SEQ ID NO: 23289 - protein, 22 aa, Brucella spp.
VLSLSFWRDEAAVAAWRNLPEH

SEQ ID NO: 23290 - protein, 22 aa, Brucella spp.
DQAIAHFLFLDGEAAARAAAEA

SEQ ID NO: 23291 - protein, 18 aa, Brucella spp.
EAGIPVIAIRNPLIRRLK

SEQ ID NO: 23292 - protein, 17 aa, Brucella spp.
IPVIAIRNPLIRRLKQG

SEQ ID NO: 23293 - protein, 19 aa, Brucella spp.
VIAIRNPLIRRLKQGTPGQ

SEQ ID NO: 23294 - protein, 24 aa, Brucella spp.
GEGVERVFPVYSPIVEGVEVVRRG

SEQ ID NO: 23295 - protein, 27 aa, Brucella spp.
GKVRRAKLYYLRGLTGKAARIAEKKDN

SEQ ID NO: 23296 - protein, 22 aa, Brucella spp.
ERFLIPGCHMHLPPLFVKKQKP

SEQ ID NO: 23297 - protein, 22 aa, Brucella spp.
CLLYIDRHLVHEVTSPQAFEGL

SEQ ID NO: 23298 - protein, 24 aa, Brucella spp.
RQGIVHIVGPEQGFTLPGMTIVCG

SEQ ID NO: 23299 - protein, 24 aa, Brucella spp.
AHFDKIVTLDAGSLPPIVSWGSSP

SEQ ID NO: 23300 - protein, 23 aa, Brucella spp.
RASKWRALDYMGLKPGTKITDIA

SEQ ID NO: 23301 - protein, 27 aa, Brucella spp.
AEAEGLHKIFIEAGFDWREPGCSMCLA

SEQ ID NO: 23302 - protein, 26 aa, Brucella spp.
MGPDSWQWHMYDTVKGSDWLGDTDAM

SEQ ID NO: 23303 - protein, 31 aa, Brucella spp.
QSLKNNAQFFIEYFALDLIMTDGVCTGVVAW

SEQ ID NO: 23304 - protein, 23 aa, Brucella spp.
PLQDMEFVQFHPTGIYGAGCLIT

SEQ ID NO: 23305 - protein, 26 aa, Brucella spp.
GKNKDHIYLHLDHLDPAVLHERLPGI

SEQ ID NO: 23306 - protein, 20 aa, Brucella spp.
IPVLPTVHYNMGGIPTNYWG

SEQ ID NO: 23307 - protein, 26 aa, Brucella spp.
KPGLRPHYHPDYYAAFVLDPDGHNIE

SEQ ID NO: 23308 - protein, 27 aa, Brucella spp.
SLRRQALIRRLRPDIEVVMYRGNVDTR

SEQ ID NO: 23309 - protein, 24 aa, Brucella spp.
IGDERIDVLLAPLAHRETQIALAC

SEQ ID NO: 23310 - protein, 23 aa, Brucella spp.
EGDRLSFRGMILTPDGRQAHEVT

SEQ ID NO: 23311 - protein, 28 aa, Brucella spp.
FRHIAPERLLPYRTLPLFAVGEGTAKAA

SEQ ID NO: 23312 - protein, 18 aa, Brucella spp.
ILGHAPFVAVMLYSGVAA

SEQ ID NO: 23313 - protein, 31 aa, Brucella spp.
AGGVIALGGMFALQWGNVIPSPGARVTAGQL

SEQ ID NO: 23314 - protein, 29 aa, Brucella spp.
KGVPTIADLNAWFGAVANRIVATENKLPA

SEQ ID NO: 23315 - protein, 27 aa, Brucella spp.
KLPADASLWDQLLASARGLVSVRPVAG

SEQ ID NO: 23316 - protein, 24 aa, Brucella spp.
RDADALVQRLVADSLKPKAPVTGA

SEQ ID NO: 23317 - protein, 21 aa, Brucella spp.
AIFDRDLMLAFRRRAFQRAEP

SEQ ID NO: 23318 - protein, 17 aa, Brucella spp.
LAFRRRAFQRAEPGADF

SEQ ID NO: 23319 - protein, 23 aa, Brucella spp.
PVSKRLFLRAAEIYAERFSDPDG

SEQ ID NO: 23320 - protein, 28 aa, Brucella spp.
PDGRIRATFSIIWLSGWAPHESQQKPLK

SEQ ID NO: 23321 - protein, 20 aa, Brucella spp.
RFIERPYCPVLGTPFGHDFG

SEQ ID NO: 23322 - protein, 30 aa, Brucella spp.
EVVLPVPLHRWRFWRRRFNQSAKLARVLAR

SEQ ID NO: 23323 - protein, 19 aa, Brucella spp.
ERSGRNTFPQIFIGSVHVG

SEQ ID NO: 23324 - protein, 19 aa, Brucella spp.
NTFPQIFIGSVHVGGCDDL

SEQ ID NO: 23325 - protein, 24 aa, Brucella spp.
VDARSWQGWQIPIQTDNAHGAARI

SEQ ID NO: 23326 - protein, 25 aa, Brucella spp.
EIDGSQIIRRMEMGQVAVVAGFQGI

SEQ ID NO: 23327 - protein, 23 aa, Brucella spp.
GSKTDMTFTIPTGDIDKALKVLD

SEQ ID NO: 23328 - protein, 27 aa, Brucella spp.
ITTSEIKISILIDGPYAELAVRTLHAV

SEQ ID NO: 23329 - protein, 19 aa, Brucella spp.
PEMLQFLGHDMIALPQDRM

SEQ ID NO: 23330 - protein, 19 aa, Brucella spp.
AVLEQDVQILLLPKDAADD

SEQ ID NO: 23331 - protein, 24 aa, Brucella spp.
SGGNDQLYLSQPLAKVFSLAEELA

SEQ ID NO: 23332 - protein, 17 aa, Brucella spp.
FVTVERLLTALAMEKSA

SEQ ID NO: 23333 - protein, 26 aa, Brucella spp.
QTAAGQIILFIDEMHTLVGAGKTDGA

SEQ ID NO: 23334 - protein, 23 aa, Brucella spp.
LSNRYITDRFLPDKAIDLVDEAA

SEQ ID NO: 23335 - protein, 28 aa, Brucella spp.
QDPNRPIGSFIFLGPTGVGKTELTKALA

SEQ ID NO: 23336 - protein, 23 aa, Brucella spp.
TKALASFLFQDDTAMVRIDMSEF

SEQ ID NO: 23337 - protein, 26 aa, Brucella spp.
EAVRRRPYQVILFDEIEKAHPDVFNV

SEQ ID NO: 23338 - protein, 23 aa, Brucella spp.
AHPDVFNVLLQVLDDGRLTDGQG

SEQ ID NO: 23339 - protein, 25 aa, Brucella spp.
VDFRNTVIIMTSNLGAEYLVNLGEN

SEQ ID NO: 23340 - protein, 33 aa, Brucella spp.
ASFRPEFLNRVDEIILFHRLRREDMGAIVDIQM

SEQ ID NO: 23341 - protein, 29 aa, Brucella spp.
GAIVDIQMQRLQYLLSDRKITLQLEDDAR

SEQ ID NO: 23342 - protein, 22 aa, Brucella spp.
DPLAERILLGDILDGSLVKITA

SEQ ID NO: 23343 - protein, 28 aa, Brucella spp.
GDEIYHDRRIRVYIDAYGRRVTMDRRGR

SEQ ID NO: 23344 - protein, 28 aa, Brucella spp.
GPNGPVGTVWIALSKPTYGIHGTPAPSR

SEQ ID NO: 23345 - protein, 30 aa, Brucella spp.
TDPNEAFELIWQFLSLADPIFERSCDGSGA

SEQ ID NO: 23346 - protein, 25 aa, Brucella spp.
CREIPFEWQILRAEVLESLGRAEEA

SEQ ID NO: 23347 - protein, 28 aa, Brucella spp.
VADANHALYFFLQYPSLSEASKLVVSRA

SEQ ID NO: 23348 - protein, 27 aa, Brucella spp.
AKFPLAATILLRAMIDFTLNNARSSRY

SEQ ID NO: 23349 - protein, 23 aa, Brucella spp.
VLAGNIIVRQRGTKWHPGANVGL

SEQ ID NO: 23350 - protein, 27 aa, Brucella spp.
RPNGLHIERVRTPLGVIGVIYESRPNV

SEQ ID NO: 23351 - protein, 32 aa, Brucella spp.
SEARVPVFAHLEGICHLYIDKSADLDMARRIA

SEQ ID NO: 23352 - protein, 24 aa, Brucella spp.
EEDWSTEYLDAIISVALVDGISGA

SEQ ID NO: 23353 - protein, 27 aa, Brucella spp.
DAQTVARFFNEIDSAILLHNASTQFAD

SEQ ID NO: 23354 - protein, 36 aa, Brucella spp.
GNRAAVFALETLGFPVWAVPTVVLPWHPGHGVPGAP

SEQ ID NO: 23355 - protein, 17 aa, Brucella spp.
VVLPWHPGHGVPGAPAG

SEQ ID NO: 23356 - protein, 25 aa, Brucella spp.
IATPNRFELSWLTGVPLEDNKALME

SEQ ID NO: 23357 - protein, 19 aa, Brucella spp.
LVTSAFPFMNGSIGNILLT

SEQ ID NO: 23358 - protein, 17 aa, Brucella spp.
AFPFMNGSIGNILLTPT

SEQ ID NO: 23359 - protein, 18 aa, Brucella spp.
PFMNGSIGNILLTPTLAL

SEQ ID NO: 23360 - protein, 28 aa, Brucella spp.
IDLNAPAPVVIMMVGLQGSGKTTTTGKI

SEQ ID NO: 23361 - protein, 25 aa, Brucella spp.
KMDALEEFYPKRIADRILGMGDIVS

SEQ ID NO: 23362 - protein, 24 aa, Brucella spp.
GLDDKVFDRQLAIIGSMTKAERAN

SEQ ID NO: 23363 - protein, 27 aa, Brucella spp.
ADINKLLKMHRQMADMMKIIGKGKGGM

SEQ ID NO: 23364 - protein, 17 aa, Brucella spp.
NIDAALIHMLAERFRCT

SEQ ID NO: 23365 - protein, 19 aa, Brucella spp.
PDFAEKFLNFIVQGSHSAS

SEQ ID NO: 23366 - protein, 25 aa, Brucella spp.
AFAAFSQLLFEWAPPEDLAAYDAAA

SEQ ID NO: 23367 - protein, 20 aa, Brucella spp.
TIVNDNMPFLLDSIMGELND

SEQ ID NO: 23368 - protein, 17 aa, Brucella spp.
PFLLDSIMGELNDHTSQ

SEQ ID NO: 23369 - protein, 26 aa, Brucella spp.
NDHTSQIFMVVHPVLDISREKDELVI

SEQ ID NO: 23370 - protein, 36 aa, Brucella spp.
AMPEAIAFLEWLRDDHFIFLGLRELVFEGTGKKRDL

SEQ ID NO: 23371 - protein, 29 aa, Brucella spp.
RAIPRLDRFGRFATVLVYIPRDRYDSAVR

SEQ ID NO: 23372 - protein, 27 aa, Brucella spp.
GGDSFEFHPVFLQNGLTRVQFVIRRHE

SEQ ID NO: 23373 - protein, 22 aa, Brucella spp.
EPLFVDFYRYRTDGPDAVSLKL

SEQ ID NO: 23374 - protein, 23 aa, Brucella spp.
KDGAPVYLHDMQLVNAYGAPVDL

SEQ ID NO: 23375 - protein, 26 aa, Brucella spp.
RLTARQIMILRSYGRYLQQAGIAYSQ

SEQ ID NO: 23376 - protein, 25 aa, Brucella spp.
IDDDQILRRFRNLIEATLRTNAYQP

SEQ ID NO: 23377 - protein, 17 aa, Brucella spp.
DGKPRVTFAFKLNPRLV

SEQ ID NO: 23378 - protein, 20 aa, Brucella spp.
KPRVTFAFKLNPRLVDGLPE

SEQ ID NO: 23379 - protein, 28 aa, Brucella spp.
AILKSKVDLLWFGGIGTYIRSSAETDAQ

SEQ ID NO: 23380 - protein, 24 aa, Brucella spp.
DVSELVLRNNYLQPLALSLSERLG

SEQ ID NO: 23381 - protein, 19 aa, Brucella spp.
LTRPELAVLLAYAKLSLLD

SEQ ID NO: 23382 - protein, 29 aa, Brucella spp.
SKLPDEPYFQSLLFGYFPKRMAKTYAEEI

SEQ ID NO: 23383 - protein, 23 aa, Brucella spp.
NLQLADIMPDIALIAHLAGADVV

SEQ ID NO: 23384 - protein, 22 aa, Brucella spp.
PAPDLHRVRRALLSVSDKTGLI

SEQ ID NO: 23385 - protein, 28 aa, Brucella spp.
GIGGIDLAVINLYPFEEVRFKGGDYDTT

SEQ ID NO: 23386 - protein, 24 aa, Brucella spp.
SGSLPLAFRKKLAAKAFSRTAAYD

SEQ ID NO: 23387 - protein, 25 aa, Brucella spp.
VAAKKNLRLLVTGGLPDPRAKGIAA

SEQ ID NO: 23388 - protein, 27 aa, Brucella spp.
CVVASDAFFPFADGLLSAVEAGATAVI

SEQ ID NO: 23389 - protein, 20 aa, Brucella spp.
PHLWGLAIAQAWRKFSRRLR

SEQ ID NO: 23390 - protein, 34 aa, Brucella spp.
WRKFSRRLRMGPLYRWRFTGFTPDRILIAPSDLR

SEQ ID NO: 23391 - protein, 19 aa, Brucella spp.
QEFYHGRFALAGRLVETGG

SEQ ID NO: 23392 - protein, 25 aa, Brucella spp.
EVTAQRIIAWLQHSNLILSGAELPA

SEQ ID NO: 23393 - protein, 17 aa, Brucella spp.
PAYRKFMRSLAMQVRYL

SEQ ID NO: 23394 - protein, 17 aa, Brucella spp.
YRKFMRSLAMQVRYLRT

SEQ ID NO: 23395 - protein, 17 aa, Brucella spp.
KFMRSLAMQVRYLRTVA

SEQ ID NO: 23396 - protein, 23 aa, Brucella spp.
SRNPVTVLELLADLLPLRQTYAN

SEQ ID NO: 23397 - protein, 25 aa, Brucella spp.
RMLPALRFFRHQDGSLALFNGVGPT

SEQ ID NO: 23398 - protein, 36 aa, Brucella spp.
ENAVALKHLLHVAVAQIFYLDLPDHSAVDLAVEAAN

SEQ ID NO: 23399 - protein, 21 aa, Brucella spp.
KAATILAMHAYEPPIDFTVKG

SEQ ID NO: 23400 - protein, 25 aa, Brucella spp.
GFAEGEWWVQDVAASLPARLMDDIK

SEQ ID NO: 23401 - protein, 23 aa, Brucella spp.
ATNLMDFKPDELFDAVLLDAPCS

SEQ ID NO: 23402 - protein, 19 aa, Brucella spp.
LLEPFPITEQDCPGLEGLV

SEQ ID NO: 23403 - protein, 19 aa, Brucella spp.
HMPDHPHLLQLFVWQDYDL

SEQ ID NO: 23404 - protein, 25 aa, Brucella spp.
HPHLLQLFVWQDYDLAPEFPVLNHF

SEQ ID NO: 23405 - protein, 27 aa, Brucella spp.
DSREKYYVLEMFPYPSGRIHMGHVRNY

SEQ ID NO: 23406 - protein, 24 aa, Brucella spp.
RAKGFNVLHPMGWDAFGMPAENAA

SEQ ID NO: 23407 - protein, 31 aa, Brucella spp.
TCDVEYYHRQQMLFIDLYEKGLVTRKTSKVN

SEQ ID NO: 23408 - protein, 27 aa, Brucella spp.
VEQRELTQWFFKITDFSEELLAGLDTL

SEQ ID NO: 23409 - protein, 31 aa, Brucella spp.
PFDDNWELPVYVANFVLMEYGTGAVFGCPAH

SEQ ID NO: 23410 - protein, 17 aa, Brucella spp.
DSSWYYTRFTAPWENEP

SEQ ID NO: 23411 - protein, 18 aa, Brucella spp.
SWYYTRFTAPWENEPTDR

SEQ ID NO: 23412 - protein, 29 aa, Brucella spp.
IGGIEHAILHLLYSRFFTRAMKVAGHVGV

SEQ ID NO: 23413 - protein, 24 aa, Brucella spp.
GAHRFVQRIWRLVAEAAPALKDVA

SEQ ID NO: 23414 - protein, 25 aa, Brucella spp.
LREATEMLVLMTAPMMPHLAEQCLA

SEQ ID NO: 23415 - protein, 25 aa, Brucella spp.
RIADNICIKLPVTLDGLKACKALTS

SEQ ID NO: 23416 - protein, 24 aa, Brucella spp.
TIYDNYDFRTEILAASVRTVNHVK

SEQ ID NO: 23417 - protein, 25 aa, Brucella spp.
QTGKTAIILDTFLNQKPIHDNGPDK

SEQ ID NO: 23418 - protein, 24 aa, Brucella spp.
PDKDKLYCVYVAVGQKRSTVAQFV

SEQ ID NO: 23419 - protein, 24 aa, Brucella spp.
ASDPAPMQYLAPFAGCAMGEYFRD

SEQ ID NO: 23420 - protein, 27 aa, Brucella spp.
QAVAYRQMSLLLRRPPGREAYPGDVFY

SEQ ID NO: 23421 - protein, 26 aa, Brucella spp.
REAYPGDVFYLHSRLLERAAKLNDEN

SEQ ID NO: 23422 - protein, 32 aa, Brucella spp.
ISITDGQIFLETNLFYQGIRPAVNVGLSVSRV

SEQ ID NO: 23423 - protein, 22 aa, Brucella spp.
GKDDVHLLVVCTAKRGLCGGFN

SEQ ID NO: 23424 - protein, 18 aa, Brucella spp.
KKGADILRREFSALLHDH

SEQ ID NO: 23425 - protein, 17 aa, Brucella spp.
ADILRREFSALLHDHVD

SEQ ID NO: 23426 - protein, 18 aa, Brucella spp.
ILRREFSALLHDHVDLRE

SEQ ID NO: 23427 - protein, 25 aa, Brucella spp.
GAFDVCTLFYSEFKSVISQVSTAQQ

SEQ ID NO: 23428 - protein, 29 aa, Brucella spp.
PAAILSTLIPRNISVQIFRALLENVAGEM

SEQ ID NO: 23429 - protein, 19 aa, Brucella spp.
KFPEGQLPLILNALEVDNQ

SEQ ID NO: 23430 - protein, 23 aa, Brucella spp.
GVGKTVLIMELINNVAKAHGGYS

SEQ ID NO: 23431 - protein, 29 aa, Brucella spp.
FRDQGQDVLFFVDNIFRFTQAGSEVSALL

SEQ ID NO: 23432 - protein, 32 aa, Brucella spp.
VARARKIERFLSQPFFVAEVFTGSPGKLVDLA

SEQ ID NO: 23433 - protein, 18 aa, Brucella spp.
IGYPLMLKASWGGGGRGM

SEQ ID NO: 23434 - protein, 34 aa, Brucella spp.
GAGTVEFLMDADTGKFYFIEVNPRIQVEHTVTEE

SEQ ID NO: 23435 - protein, 19 aa, Brucella spp.
IVKAQIHILEGFAIGTPES

SEQ ID NO: 23436 - protein, 27 aa, Brucella spp.
TAYSGAFITRYYDPLLVKVTASGATPL

SEQ ID NO: 23437 - protein, 34 aa, Brucella spp.
RALREFRIRGVATNLTFLEAIINHPKFLSNDYTT

SEQ ID NO: 23438 - protein, 23 aa, Brucella spp.
QALPNLFSLECWGGATFDVSMRF

SEQ ID NO: 23439 - protein, 22 aa, Brucella spp.
TFDVSMRFLTEDPWERLALVRE

SEQ ID NO: 23440 - protein, 28 aa, Brucella spp.
VREGAPNLLLQMLLRGANGVGYKSYPDN

SEQ ID NO: 23441 - protein, 27 aa, Brucella spp.
AARAGIDLFRVFDSLNWVENMRVSMDA

SEQ ID NO: 23442 - protein, 29 aa, Brucella spp.
SGLDPDLIRRISFYWEAVRHQYAAFESDL

SEQ ID NO: 23443 - protein, 27 aa, Brucella spp.
GPTSVLPTPVYFYGLKPEEEVFVDLER

SEQ ID NO: 23444 - protein, 25 aa, Brucella spp.
DEKGMVTVFFELNGQPRRIKVPNRA

SEQ ID NO: 23445 - protein, 33 aa, Brucella spp.
RLERLGHDVPLVGDFHYIGHKLLADHPACAEAL

SEQ ID NO: 23446 - protein, 22 aa, Brucella spp.
SAAMGILLQQGIGDTIRISLTP

SEQ ID NO: 23447 - protein, 30 aa, Brucella spp.
VQVAQELLQTMGFRQFVPIVAACPGCGRTT

SEQ ID NO: 23448 - protein, 26 aa, Brucella spp.
EDIRRNMPLWREKYPGVEALSVAVMG

SEQ ID NO: 23449 - protein, 25 aa, Brucella spp.
RQDGASMLRFEIGSGKAYGALAVGT

SEQ ID NO: 23450 - protein, 33 aa, Brucella spp.
ERLSPEWTLHRIWHLLYVDMLNYDELALMAAIP

SEQ ID NO: 23451 - protein, 23 aa, Brucella spp.
DRPVSMVFQENNLFAHLTVEQNV

SEQ ID NO: 23452 - protein, 24 aa, Brucella spp.
LVRERPVLLLDEAFASLGPALRHQ

SEQ ID NO: 23453 - protein, 29 aa, Brucella spp.
TPEDALHLDALLIFLDNGKIAAQGPATEM

SEQ ID NO: 23454 - protein, 29 aa, Brucella spp.
EAWPLPPGDYIYDFPDGTPFSVINFSTVE

SEQ ID NO: 23455 - protein, 22 aa, Brucella spp.
IKNAKWPLDNVTLPFGSSWTVS

SEQ ID NO: 23456 - protein, 27 aa, Brucella spp.
WNRRATVYFLQKDYAYAMYDINRTLEL

SEQ ID NO: 23457 - protein, 37 aa, Brucella spp.
AAEKLLHALDYVGVLGLEFFVLKDGTLLANEFAPRVH

SEQ ID NO: 23458 - protein, 23 aa, Brucella spp.
GMAAAMTPLPVFGVPVQSKALSG

SEQ ID NO: 23459 - protein, 23 aa, Brucella spp.
QDSLLSIVQMPAGIPVGTLAIGR

SEQ ID NO: 23460 - protein, 22 aa, Brucella spp.
AMDDLHIASLKRKKLVLKEQIE

SEQ ID NO: 23461 - protein, 20 aa, Brucella spp.
AMLDDTMVPALYALTGGQYL

SEQ ID NO: 23462 - protein, 17 aa, Brucella spp.
FIRTQRAIDGLPKDLRK

SEQ ID NO: 23463 - protein, 29 aa, Brucella spp.
SFGEIGDLRLTVMAGIMVMDELAEMQKRI

SEQ ID NO: 23464 - protein, 18 aa, Brucella spp.
TIAFREFLPDAELVPTGF

SEQ ID NO: 23465 - protein, 26 aa, Brucella spp.
APLVDPAIMLMPLAGFDRLGHRLGYG

SEQ ID NO: 23466 - protein, 29 aa, Brucella spp.
WEDANRRFHRLILTPCKMPRLLAAIDDLH

SEQ ID NO: 23467 - protein, 26 aa, Brucella spp.
LHAASARFLFATWRSAWEARTDHDHR

SEQ ID NO: 23468 - protein, 26 aa, Brucella spp.
LEQKDFSFLYEQGEALIFMDTETYEQ

SEQ ID NO: 23469 - protein, 19 aa, Brucella spp.
EKPIGIRLPDQVTLAITEA

SEQ ID NO: 23470 - protein, 18 aa, Brucella spp.
GIRLPDQVTLAITEADPV

SEQ ID NO: 23471 - protein, 26 aa, Brucella spp.
VLENGIRIPVPPFIASGERVIVDTNE

SEQ ID NO: 23472 - protein, 29 aa, Brucella spp.
AESMRLTTRLMQIASWLLLQRAARSGEMT

SEQ ID NO: 23473 - protein, 26 aa, Brucella spp.
HGEKQQIHMMVKVLMPRASFDTSDAA

SEQ ID NO: 23474 - protein, 36 aa, Brucella spp.
GEAAILFIETYVREDMIRLYGFATQLEREWFRLLQN

SEQ ID NO: 23475 - protein, 27 aa, Brucella spp.
FATQLEREWFRLLQNVQGVGAKVALAV

SEQ ID NO: 23476 - protein, 24 aa, Brucella spp.
LLTTPLRDRFGIPVRLNFYTVEEL

SEQ ID NO: 23477 - protein, 19 aa, Brucella spp.
GIPVRLNFYTVEELEYIVR

SEQ ID NO: 23478 - protein, 17 aa, Brucella spp.
RLNFYTVEELEYIVRRG

SEQ ID NO: 23479 - protein, 27 aa, Brucella spp.
RDAIEDIIEPYLIQQGFLQRTPRGRVL

SEQ ID NO: 23480 - protein, 23 aa, Brucella spp.
RVLTAVAWQHLGLPAPAEIIQQS

SEQ ID NO: 23481 - protein, 26 aa, Brucella spp.
KDGAHLLYARIYYADTDFSGFVYHGR

SEQ ID NO: 23482 - protein, 20 aa, Brucella spp.
VYHGRYLEFYERGRTDFLRL

SEQ ID NO: 23483 - protein, 18 aa, Brucella spp.
YLEFYERGRTDFLRLQNV

SEQ ID NO: 23484 - protein, 28 aa, Brucella spp.
GGSDSLGLLFLLKDYLSTLESPPVLIAV

SEQ ID NO: 23485 - protein, 19 aa, Brucella spp.
DLVPGQHIVWDGRFCFFNS

SEQ ID NO: 23486 - protein, 25 aa, Brucella spp.
HIVWDGRFCFFNSGGRSFEIAPPGR

SEQ ID NO: 23487 - protein, 26 aa, Brucella spp.
YEGGKLAFVPFLPGAEWPQGVHIERH

SEQ ID NO: 23488 - protein, 25 aa, Brucella spp.
VHIERHFAIFDHVLPGHDFALAQAV

SEQ ID NO: 23489 - protein, 31 aa, Brucella spp.
LESYKPAWPLPKIFRMTKGGKLIEGIFVGET

SEQ ID NO: 23490 - protein, 25 aa, Brucella spp.
DVTPDVLRVAENAPLILSIHRELDA

SEQ ID NO: 23491 - protein, 28 aa, Brucella spp.
LTSVADQILPYIDQVWRVLDERRKAGAR

SEQ ID NO: 23492 - protein, 17 aa, Brucella spp.
RILFEGAQGALLDNDHG

SEQ ID NO: 23493 - protein, 25 aa, Brucella spp.
TGRKRRCGWFDAVIVRQTVRTSGIN

SEQ ID NO: 23494 - protein, 23 aa, Brucella spp.
AVKYVRHIEELIGAPVAMLSTSP

SEQ ID NO: 23495 - protein, 26 aa, Brucella spp.
AEDRQIVLLPGRRTLVPTGLILEIPQ

SEQ ID NO: 23496 - protein, 18 aa, Brucella spp.
RIERGMRIAQAVFAPVIQ

SEQ ID NO: 23497 - protein, 18 aa, Brucella spp.
GLYRLFCNLYKNASIRMP

SEQ ID NO: 23498 - protein, 24 aa, Brucella spp.
QVATRLMIIEDEPLIAMDIEQMVE

SEQ ID NO: 23499 - protein, 28 aa, Brucella spp.
EILHDNTIPVIFITAFPERLLTGERPEP

SEQ ID NO: 23500 - protein, 17 aa, Brucella spp.
DQWLAAALGPELSRSRV

SEQ ID NO: 23501 - protein, 24 aa, Brucella spp.
ENIPLDILYEDDDLIVINKPAGLV

SEQ ID NO: 23502 - protein, 21 aa, Brucella spp.
GDLERAYLALVWGMTERPQGT

SEQ ID NO: 23503 - protein, 31 aa, Brucella spp.
VQGFHRQALHAWLLAFTHPITEELMRFEAPL

SEQ ID NO: 23504 - protein, 42 aa, Brucella spp.
FEPERGFRLATYAMWWIKASIQEYILRSWSLVKMGTTANQKR

SEQ ID NO: 23505 - protein, 24 aa, Brucella spp.
ANQKRLFFNLRKMKSKIQALDDGD

SEQ ID NO: 23506 - protein, 26 aa, Brucella spp.
TGVEPEKFWKGFAAIIRDLAPKNRAL

SEQ ID NO: 23507 - protein, 26 aa, Brucella spp.
YSQADYQQFLKDIGYLLPEGGAFSVS

SEQ ID NO: 23508 - protein, 28 aa, Brucella spp.
AEDKVAVYRNWLGLMNGKLEDTFEKNGK

SEQ ID NO: 23509 - protein, 23 aa, Brucella spp.
LKGRSLMLVRNVGHLMTNPAILD

SEQ ID NO: 23510 - protein, 25 aa, Brucella spp.
RAAKDRVVFINTGFLDRTGDEIHTS

SEQ ID NO: 23511 - protein, 25 aa, Brucella spp.
QIGKGMWAMPDMMAAMLEQKIAHPK

SEQ ID NO: 23512 - protein, 19 aa, Brucella spp.
QGILGYVVRWIDQGVGCSK

SEQ ID NO: 23513 - protein, 23 aa, Brucella spp.
AQHIANWLYHGVVSEAQVMETMK

SEQ ID NO: 23514 - protein, 28 aa, Brucella spp.
ALEQGIYDDLHWLGLRWETPVRRQSEHF

SEQ ID NO: 23515 - protein, 28 aa, Brucella spp.
HATSVHRLLQKLLGLPEPLYHHHDLVLG

SEQ ID NO: 23516 - protein, 21 aa, Brucella spp.
ANRLWKLIHEEDFVNALGALS

SEQ ID NO: 23517 - protein, 29 aa, Brucella spp.
RAIAYAPYCDLIWMETSKPDLAQARRFAE

SEQ ID NO: 23518 - protein, 31 aa, Brucella spp.
RELGAMGYKFQFITLAGFHQLNYGMFELARG

SEQ ID NO: 23519 - protein, 34 aa, Brucella spp.
ARGDAQLVLAHDLSTVLWVNGPGAKLFGYNRVED

SEQ ID NO: 23520 - protein, 25 aa, Brucella spp.
TDTPALHLLCIVGDAPAQFQTAAEA

SEQ ID NO: 23521 - protein, 34 aa, Brucella spp.
PRPKTFAFDHDAPPARFIWKVGPDGTFSEISPDL

SEQ ID NO: 23522 - protein, 27 aa, Brucella spp.
DTWSGKRLLWPVEGTRLRVPVELAALP

SEQ ID NO: 23523 - protein, 23 aa, Brucella spp.
YSRDREFLGFRGFGIVRPAEAEA

SEQ ID NO: 23524 - protein, 20 aa, Brucella spp.
LLANLPVPVIIHSGDAIHYV

SEQ ID NO: 23525 - protein, 26 aa, Brucella spp.
WRGGRALMLSLMPVTAADLPAPAELP

SEQ ID NO: 23526 - protein, 26 aa, Brucella spp.
DEAEGKFFSMLFAIESQRAAMDYLHG

SEQ ID NO: 23527 - protein, 30 aa, Brucella spp.
GREAKGGFIPLFMTIGKLPHTRGFCAVLRD

SEQ ID NO: 23528 - protein, 22 aa, Brucella spp.
DALQMPLMTRGIGPGHAVFVPS

SEQ ID NO: 23529 - protein, 20 aa, Brucella spp.
HAVFVPSFTFAATAEVVALV

SEQ ID NO: 23530 - protein, 27 aa, Brucella spp.
RLEPKAIIPVDLFGLAASYNRITAIAE

SEQ ID NO: 23531 - protein, 28 aa, Brucella spp.
QAEGIPSVIYYVKPLHLQTAYKHYSVAP

SEQ ID NO: 23532 - protein, 25 aa, Brucella spp.
ESLPSRILSLPMHPYLSEADQDKII

SEQ ID NO: 23533 - protein, 22 aa, Brucella spp.
ITDINHFAYPTFAKAARQRRDN

SEQ ID NO: 23534 - protein, 21 aa, Brucella spp.
SLGIPHYVLDYEARFREAVID

SEQ ID NO: 23535 - protein, 39 aa, Brucella spp.
TDRDQSYFLFATTQEQIDYLRFPLGHLPKAQVREIAEEL

SEQ ID NO: 23536 - protein, 18 aa, Brucella spp.
QDSQDICFVPQGKYSDII

SEQ ID NO: 23537 - protein, 20 aa, Brucella spp.
QDICFVPQGKYSDIISRLKP

SEQ ID NO: 23538 - protein, 23 aa, Brucella spp.
TGEALYVVHLDAANARVIVGPRE

SEQ ID NO: 23539 - protein, 25 aa, Brucella spp.
LETHKVFLRDVNWLGDTPIADLPKS

SEQ ID NO: 23540 - protein, 26 aa, Brucella spp.
VVRERLEFPYADLVTIAYVLDELAPD

SEQ ID NO: 23541 - protein, 35 aa, Brucella spp.
DEREKLIERLWASARQMFVIVEPGTPAGWRRILDA

SEQ ID NO: 23542 - protein, 26 aa, Brucella spp.
RKERMFRLLIDMGFPEIEIGFPSASQ

SEQ ID NO: 23543 - protein, 25 aa, Brucella spp.
EGAKTPIIHFYNSTSELQRRVVFAK

SEQ ID NO: 23544 - protein, 25 aa, Brucella spp.
RSANSPVWEVPYLPIDPQDVGRSYE

SEQ ID NO: 23545 - protein, 24 aa, Brucella spp.
SAISYVEMVYPGGKLFGVGINDNI

SEQ ID NO: 23546 - protein, 26 aa, Brucella spp.
ADGRRAFRYLKGPIFAQLLMADEINR

SEQ ID NO: 23547 - protein, 29 aa, Brucella spp.
LPEAQLDRFLMQIDILYPELAAERRILLE

SEQ ID NO: 23548 - protein, 19 aa, Brucella spp.
LTEAPLRMLMNNLDPDVAE

SEQ ID NO: 23549 - protein, 18 aa, Brucella spp.
GNLKGRWILTGGLGGMGG

SEQ ID NO: 23550 - protein, 17 aa, Brucella spp.
RWILTGGLGGMGGAQPL

SEQ ID NO: 23551 - protein, 17 aa, Brucella spp.
DPVHGYLPLGWTVAEWR

SEQ ID NO: 23552 - protein, 25 aa, Brucella spp.
KVQVQAMLDFWNAGIPTVDYGNNIR

SEQ ID NO: 23553 - protein, 38 aa, Brucella spp.
GLENAFAFPGFVPAYIRPLFCRGIGPFRWAALSGDPED

SEQ ID NO: 23554 - protein, 18 aa, Brucella spp.
MAKERIAFQGLPARICWV

SEQ ID NO: 23555 - protein, 24 aa, Brucella spp.
IAFQGLPARICWVGLGDRHRLGLA

SEQ ID NO: 23556 - protein, 17 aa, Brucella spp.
ICWVGLGDRHRLGLAFN

SEQ ID NO: 23557 - protein, 27 aa, Brucella spp.
EIKADGTWFYMGTPIGRKQLVRLFSTV

SEQ ID NO: 23558 - protein, 17 aa, Brucella spp.
IGRKQLVRLFSTVLRKD

SEQ ID NO: 23559 - protein, 17 aa, Brucella spp.
RKQLVRLFSTVLRKDED

SEQ ID NO: 23560 - protein, 24 aa, Brucella spp.
GGLKPYILVRGRLEALVARSVMYD

SEQ ID NO: 23561 - protein, 17 aa, Brucella spp.
IFEVPLSFLMNPANHRR

SEQ ID NO: 23562 - protein, 34 aa, Brucella spp.
FNGKERFYYAMPYHERFIWGATAGIIRGLYERLY

SEQ ID NO: 23563 - protein, 34 aa, Brucella spp.
EQRIREDYLRILRFFRFFAWYGSGRPEAEGLRAS

SEQ ID NO: 23564 - protein, 26 aa, Brucella spp.
PDPSRALLWMRQAGVLNLVLPESEKW

SEQ ID NO: 23565 - protein, 25 aa, Brucella spp.
ELSPRPLLHLPKIIPQVLTGRNSLH

SEQ ID NO: 23566 - protein, 23 aa, Brucella spp.
PTRRDFLYIATGMAGVVGVGGLA

SEQ ID NO: 23567 - protein, 22 aa, Brucella spp.
VGGLAWPFIDQMRPDASTLAAA

SEQ ID NO: 23568 - protein, 25 aa, Brucella spp.
EGKENWLVMIGVCTHLGCVPLGESG

SEQ ID NO: 23569 - protein, 17 aa, Brucella spp.
WILGVVIFLLMMATAFM

SEQ ID NO: 23570 - protein, 29 aa, Brucella spp.
DAFGALVFFVFFAYFIFYLPNFLGHPDNY

SEQ ID NO: 23571 - protein, 31 aa, Brucella spp.
RSAVYRPWFKLFFWLFVINAIFLGWLGSRPA

SEQ ID NO: 23572 - protein, 26 aa, Brucella spp.
SVERGFPQFIFDIFTQYAEGGPDYIH

SEQ ID NO: 23573 - protein, 30 aa, Brucella spp.
DRKKTGFRVIVFLVLFAGLVYIAKRSIWSD

SEQ ID NO: 23574 - protein, 22 aa, Brucella spp.
AAKLLLQMGAEIVAACFIIDLP

SEQ ID NO: 23575 - protein, 27 aa, Brucella spp.
MGAEIVAACFIIDLPDLGGRKKLEALG

SEQ ID NO: 23576 - protein, 22 aa, Brucella spp.
KEIIPTRINFVDIAGLVRGASK

SEQ ID NO: 23577 - protein, 17 aa, Brucella spp.
KEALAILPVMEKALELL

SEQ ID NO: 23578 - protein, 25 aa, Brucella spp.
QNGQPVRLMLKDISPEDLLTLKGLN

SEQ ID NO: 23579 - protein, 19 aa, Brucella spp.
TLKGLNLLTSKPVLYVCNV

SEQ ID NO: 23580 - protein, 31 aa, Brucella spp.
LDRLIRAGYKLLDLITYFTAGPKETRAWTIK

SEQ ID NO: 23581 - protein, 28 aa, Brucella spp.
QSIGEAMRFYKLTPADLVVIYDELDLVP

SEQ ID NO: 23582 - protein, 23 aa, Brucella spp.
PADLVVIYDELDLVPGKLRIKTG

SEQ ID NO: 23583 - protein, 27 aa, Brucella spp.
AIAVSYKEIFYKIHGGGFKTTVATIEV

SEQ ID NO: 23584 - protein, 17 aa, Brucella spp.
QVLPKDYQLDPVRDFPQ

SEQ ID NO: 23585 - protein, 25 aa, Brucella spp.
QLDPVRDFPQHVDFLRVSAKSVVHV

SEQ ID NO: 23586 - protein, 29 aa, Brucella spp.
LFDAERDYWYPMLVVVDEAQLFAPAAAGE

SEQ ID NO: 23587 - protein, 25 aa, Brucella spp.
AEASNFLMGRTFLDIDMARAADLLG

SEQ ID NO: 23588 - protein, 18 aa, Brucella spp.
DLQRGHFVALGPALSRRP

SEQ ID NO: 23589 - protein, 27 aa, Brucella spp.
SFRSVAVLYQDFLVRCRIHRVPGEPLA

SEQ ID NO: 23590 - protein, 18 aa, Brucella spp.
RLLAYFEERGLLVVRNDF

SEQ ID NO: 23591 - protein, 28 aa, Brucella spp.
SYPANDHLMELLIMIDAFRRSSARRITA

SEQ ID NO: 23592 - protein, 19 aa, Brucella spp.
ARRITAVLPYFGYARQDRK

SEQ ID NO: 23593 - protein, 24 aa, Brucella spp.
AGQIQGFFDIPTDNLYAVPVIARD

SEQ ID NO: 23594 - protein, 45 aa, Brucella spp.
EEEKLDALLLFAQESMYWLTGYDTFGFCFFQCLVVKADGSMVLMT

SEQ ID NO: 23595 - protein, 21 aa, Brucella spp.
RHYHAPMMCTLIIGKPTKHHM

SEQ ID NO: 23596 - protein, 19 aa, Brucella spp.
SWMDPQMFYAANPESIQPD

SEQ ID NO: 23597 - protein, 25 aa, Brucella spp.
IQPDMTLFAHMIIMDSDTQTAMTLG

SEQ ID NO: 23598 - protein, 31 aa, Brucella spp.
RPSEKPEHYLFDLWTFITDRLTKAGVQADAL

SEQ ID NO: 23599 - protein, 29 aa, Brucella spp.
VSQMFGELIGIWCLSEWDALARPANFVLC

SEQ ID NO: 23600 - protein, 21 aa, Brucella spp.
KAHVEWFERFADIPADTVHGP

SEQ ID NO: 23601 - protein, 33 aa, Brucella spp.
DTVHGPLILVTNELFDAIPFRQFVKADGRFVER

SEQ ID NO: 23602 - protein, 17 aa, Brucella spp.
PFRQFVKADGRFVERMI

SEQ ID NO: 23603 - protein, 19 aa, Brucella spp.
TMTQGEFLLAMGLVDRAGR

SEQ ID NO: 23604 - protein, 18 aa, Brucella spp.
GTLFKVLAFSDEQTRLLP

SEQ ID NO: 23605 - protein, 19 aa, Brucella spp.
VGILFAWWYGKKLLRSHRL

SEQ ID NO: 23606 - protein, 21 aa, Brucella spp.
IGYVLFYNFSYYISNPLAIPA

SEQ ID NO: 23607 - protein, 29 aa, Brucella spp.
EAFLEGLVLFFVLFVLVWGARKLKQPGFV

SEQ ID NO: 23608 - protein, 25 aa, Brucella spp.
SEKSALLARIEALEARLAKFEGGSS

SEQ ID NO: 23609 - protein, 33 aa, Brucella spp.
KQVMAVVNFPPRQIGPFMSEVLTLGMPDEDGEV

SEQ ID NO: 23610 - protein, 31 aa, Brucella spp.
LYARSLIIIIAPMVLLQSVIAYVFMERHWQM

SEQ ID NO: 23611 - protein, 23 aa, Brucella spp.
GPKPFFAILDYFLSEEITRQINR

SEQ ID NO: 23612 - protein, 38 aa, Brucella spp.
YASNTGIFLTWMVGTALVLLIIAIAFLRNQIKPIQQLA

SEQ ID NO: 23613 - protein, 24 aa, Brucella spp.
GIDFDLLILDVMMPGETGVSLTRS

SEQ ID NO: 23614 - protein, 31 aa, Brucella spp.
PAQPKIEQIVFGPYTFFIPRRELKKGTETIK

SEQ ID NO: 23615 - protein, 29 aa, Brucella spp.
EATDLNVIELLFFSYRDFTADPDLILEKI

SEQ ID NO: 23616 - protein, 24 aa, Brucella spp.
RAHHRVLYFINRKPGMTVAELLEV

SEQ ID NO: 23617 - protein, 18 aa, Brucella spp.
QSGNPLFKHGELWTPHRP

SEQ ID NO: 23618 - protein, 20 aa, Brucella spp.
NPLFKHGELWTPHRPARPEK

SEQ ID NO: 23619 - protein, 21 aa, Brucella spp.
TQRPALILAPNKTLAAQLYGE

SEQ ID NO: 23620 - protein, 38 aa, Brucella spp.
LYGEFKSFFPNNAVEYFVSYYDYYQPEAYVPRSDTYIE

SEQ ID NO: 23621 - protein, 22 aa, Brucella spp.
DTIEIFPAHLEDRAWRISLFGD

SEQ ID NO: 23622 - protein, 28 aa, Brucella spp.
PGEPPPTLFEYIPDNALVFIDESHVTVP

SEQ ID NO: 23623 - protein, 21 aa, Brucella spp.
NRPLRFEEWDAMRPQTIAVSA

SEQ ID NO: 23624 - protein, 36 aa, Brucella spp.
IDTLERIEIIRDLRLGAFDVLVGINLLREGLDIPEC

SEQ ID NO: 23625 - protein, 25 aa, Brucella spp.
ANSAYDIFGGWVMAQMDMAAGIRSA

SEQ ID NO: 23626 - protein, 19 aa, Brucella spp.
DLVTHAEFIMVALDADGKP

SEQ ID NO: 23627 - protein, 32 aa, Brucella spp.
ACIGHARFLSRHLTPILLLALLAGCSGERAPR

SEQ ID NO: 23628 - protein, 31 aa, Brucella spp.
NNGKNIMVRKPGFFAFREKGLLNTVRSDACS

SEQ ID NO: 23629 - protein, 22 aa, Brucella spp.
LKEELRWRQQSERPRIIEAIAE

SEQ ID NO: 23630 - protein, 17 aa, Brucella spp.
RISISSPIARALIGKGE

SEQ ID NO: 23631 - protein, 24 aa, Brucella spp.
AESNAILLYLAEGTRFLPVDPYER

SEQ ID NO: 23632 - protein, 30 aa, Brucella spp.
DPYERALVYQWLFFEQYSHEPYIAVRRALK

SEQ ID NO: 23633 - protein, 30 aa, Brucella spp.
RRDLTAFFHQLMVFFGIAGSLLVLNVSQTW

SEQ ID NO: 23634 - protein, 26 aa, Brucella spp.
LNVSQTWLNLMFKLKLREGLARDLIG

SEQ ID NO: 23635 - protein, 24 aa, Brucella spp.
LLQSTVILISFIGVLWSLSSGFVF

SEQ ID NO: 23636 - protein, 25 aa, Brucella spp.
SIPGYMVWAVIIYAASASWLTWIVG

SEQ ID NO: 23637 - protein, 25 aa, Brucella spp.
TETQRTLLFRALGGLWPWGEGRIGM

SEQ ID NO: 23638 - protein, 25 aa, Brucella spp.
RQCLAFARLILQQPKWIVIDGALDG

SEQ ID NO: 23639 - protein, 19 aa, Brucella spp.
SILIIGAGPIVIGQACEFD

SEQ ID NO: 23640 - protein, 25 aa, Brucella spp.
LKEEGYRIILVNSNPATIMTDPDLA

SEQ ID NO: 23641 - protein, 19 aa, Brucella spp.
VVGLPAIIRPSFTLGGTGG

SEQ ID NO: 23642 - protein, 31 aa, Brucella spp.
PSIDYVVTKIPRFAFEKFPGSSPILTTAMKS

SEQ ID NO: 23643 - protein, 25 aa, Brucella spp.
DASKIDPWFLEQIESIVKTEERIRE

SEQ ID NO: 23644 - protein, 25 aa, Brucella spp.
YDTSDRLYFEPLTAEDVLEILRVEK

SEQ ID NO: 23645 - protein, 27 aa, Brucella spp.
AEDRDRFQKLLIKLDLNQPKNGIAYSV

SEQ ID NO: 23646 - protein, 29 aa, Brucella spp.
RLVAADLGFPLVVRPSYVLGGRAMQIIHD

SEQ ID NO: 23647 - protein, 18 aa, Brucella spp.
IHDERGLQAYLLDTVPEL

SEQ ID NO: 23648 - protein, 26 aa, Brucella spp.
TLLGKNPLLFDTYLTEAIEVDVDCLC

SEQ ID NO: 23649 - protein, 23 aa, Brucella spp.
SGDSACLLPVHTLSPEIVAELER

SEQ ID NO: 23650 - protein, 27 aa, Brucella spp.
HIAVKEAVFPFARFPGVDTLLGPEMRS

SEQ ID NO: 23651 - protein, 18 aa, Brucella spp.
TLMQKLPYYTTMAGAESA

SEQ ID NO: 23652 - protein, 18 aa, Brucella spp.
SWLKHRGIIALAGIDTRA

SEQ ID NO: 23653 - protein, 24 aa, Brucella spp.
TIGQSLVWKELPWTLQDGYGEQDA

SEQ ID NO: 23654 - protein, 25 aa, Brucella spp.
FGVKRNILRLLTGLGAKVTVLPATA

SEQ ID NO: 23655 - protein, 28 aa, Brucella spp.
LVETGIPLFGICLGHQMLALALGGRTEK

SEQ ID NO: 23656 - protein, 28 aa, Brucella spp.
PGPQDSHYLFRRFINLIRERKGQAPLPE

SEQ ID NO: 23657 - protein, 22 aa, Brucella spp.
EKRRMSTLRLVMAAVKDRDIAN

SEQ ID NO: 23658 - protein, 24 aa, Brucella spp.
AEREEIAIISEFLPQQMTEDETKK

SEQ ID NO: 23659 - protein, 22 aa, Brucella spp.
TGDHFKFLTDLEGLSFPEAVER

SEQ ID NO: 23660 - protein, 20 aa, Brucella spp.
RATLYDVMELAAQFFESQLQ

SEQ ID NO: 23661 - protein, 30 aa, Brucella spp.
IAVSYDRFRDRVMFPIEDLRGRIIAFGGRA

SEQ ID NO: 23662 - protein, 29 aa, Brucella spp.
ALTEEQLELLWRISPEPILCFDGDGAGLR

SEQ ID NO: 23663 - protein, 27 aa, Brucella spp.
APLRETAIVLTLLNHPRLIEEDFETLA

SEQ ID NO: 23664 - protein, 20 aa, Brucella spp.
LKTLHLAMLDVLAAGRVDDG

SEQ ID NO: 23665 - protein, 24 aa, Brucella spp.
TDDPVRMYLREMGSVELLSREGEI

SEQ ID NO: 23666 - protein, 30 aa, Brucella spp.
LCESPLSFQAIIIWRDQLNESNILLREIID

SEQ ID NO: 23667 - protein, 25 aa, Brucella spp.
LNESNILLREIIDLETTYAGPEAKQ

SEQ ID NO: 23668 - protein, 19 aa, Brucella spp.
QVMETLDFIADTYKKLRKL

SEQ ID NO: 23669 - protein, 17 aa, Brucella spp.
MVEANLRLVISIAKKYT

SEQ ID NO: 23670 - protein, 24 aa, Brucella spp.
TNRGLQFLDLIQEGNIGLMKAVDK

SEQ ID NO: 23671 - protein, 34 aa, Brucella spp.
KFEYRRGYKFSTYATWWIRQAITRSIADQARTIR

SEQ ID NO: 23672 - protein, 22 aa, Brucella spp.
RTIRIPVHMIETINKIVRTSRQ

SEQ ID NO: 23673 - protein, 17 aa, Brucella spp.
HMIETINKIVRTSRQML

SEQ ID NO: 23674 - protein, 17 aa, Brucella spp.
ERVLRMRFGIGMNTDHT

SEQ ID NO: 23675 - protein, 25 aa, Brucella spp.
KEAGRLEHKDFLIIATPYSEGGQYQ

SEQ ID NO: 23676 - protein, 19 aa, Brucella spp.
FVVTAAIGVAAMFSASASA

SEQ ID NO: 23677 - protein, 18 aa, Brucella spp.
MTASPDMAILNLSVLRQA

SEQ ID NO: 23678 - protein, 30 aa, Brucella spp.
ISELSRPPMPMPIARGQFRTMLAAAPDNSV

SEQ ID NO: 23679 - protein, 25 aa, Brucella spp.
GKALHSPCWSALLLTMIAQVKTKGL

SEQ ID NO: 23680 - protein, 31 aa, Brucella spp.
RLSKKWAIPVSVKFWWKQNPKAQYPGKTGIL

SEQ ID NO: 23681 - protein, 19 aa, Brucella spp.
GLVWPAMVDQLRMNEVIME

SEQ ID NO: 23682 - protein, 23 aa, Brucella spp.
LAGGLLYFPEYAKYQDPSTAKPE

SEQ ID NO: 23683 - protein, 28 aa, Brucella spp.
KPEDSLAPWDFLTWALANFSTVAEVKDA

SEQ ID NO: 23684 - protein, 25 aa, Brucella spp.
TNSPSFDWHMTNLRNYVYLSRENPK

SEQ ID NO: 23685 - protein, 24 aa, Brucella spp.
SEEQNMFEYTQWTAFADMKNDVYY

SEQ ID NO: 23686 - protein, 17 aa, Brucella spp.
ITAIELVELIGKKPWLL

SEQ ID NO: 23687 - protein, 30 aa, Brucella spp.
AIELVELIGKKPWLLETLITNASQKTNGTG

SEQ ID NO: 23688 - protein, 18 aa, Brucella spp.
WPMIFTVLGLAGAVWLGY

SEQ ID NO: 23689 - protein, 18 aa, Brucella spp.
WQHRFLTWGIVIAVFGMR

SEQ ID NO: 23690 - protein, 17 aa, Brucella spp.
GMRIVFPLGIVAIAMWT

SEQ ID NO: 23691 - protein, 18 aa, Brucella spp.
AILVLAIIMYVQTLVHIP

SEQ ID NO: 23692 - protein, 28 aa, Brucella spp.
GAEFHPDLQWWRAQLVVRKGFRIGIDSY

SEQ ID NO: 23693 - protein, 18 aa, Brucella spp.
EMLPWNDRLQMLECISAI

SEQ ID NO: 23694 - protein, 25 aa, Brucella spp.
KTTEDNWFRYTPGQFVTLELPLERA

SEQ ID NO: 23695 - protein, 25 aa, Brucella spp.
GSIGTRWMLDNLRPPMKIKAYGPNG

SEQ ID NO: 23696 - protein, 17 aa, Brucella spp.
PGDKYLFISAGSGITPM

SEQ ID NO: 23697 - protein, 19 aa, Brucella spp.
LFISAGSGITPMMSMTRWL

SEQ ID NO: 23698 - protein, 24 aa, Brucella spp.
TPMMSMTRWLFDCAPATDVSFINC

SEQ ID NO: 23699 - protein, 22 aa, Brucella spp.
TPDDIIFRKELELLSGRMEAMR

SEQ ID NO: 23700 - protein, 19 aa, Brucella spp.
RLELLAPDFLQREIFCCGP

SEQ ID NO: 23701 - protein, 26 aa, Brucella spp.
YKLDLENIFYKDWLFVGHDCELPKTG

SEQ ID NO: 23702 - protein, 20 aa, Brucella spp.
VCPYHQWTYELDGRLLFARQ

SEQ ID NO: 23703 - protein, 27 aa, Brucella spp.
STNIGAMLLFNYPSTWNHLMADHAISF

SEQ ID NO: 23704 - protein, 17 aa, Brucella spp.
HLMADHAISFRVLPISA

SEQ ID NO: 23705 - protein, 25 aa, Brucella spp.
EGGVMQFLEWYTNTMTPRLRGEAAK

SEQ ID NO: 23706 - protein, 23 aa, Brucella spp.
RTLNHYIHQTYADLPVVLFGHSM

SEQ ID NO: 23707 - protein, 25 aa, Brucella spp.
GFDASVALWIDIFHMIRRGANNRNF

SEQ ID NO: 23708 - protein, 25 aa, Brucella spp.
DDAARIDIWHTIYNHPLAGVDAIVE

SEQ ID NO: 23709 - protein, 24 aa, Brucella spp.
NLVEWYDFYVYSFGALYFASQFFP

SEQ ID NO: 23710 - protein, 18 aa, Brucella spp.
APFLLLVVRLVQGLSVGG

SEQ ID NO: 23711 - protein, 28 aa, Brucella spp.
ASETMTFVLLVFMLMQPLFGALSDKVGR

SEQ ID NO: 23712 - protein, 24 aa, Brucella spp.
QSSTWAFIYIVIALAVVSMYTSVS

SEQ ID NO: 23713 - protein, 28 aa, Brucella spp.
QGMESGFFWYVTAIMVVVFIVSLLMPNP

SEQ ID NO: 23714 - protein, 18 aa, Brucella spp.
IMVVVFIVSLLMPNPREH

SEQ ID NO: 23715 - protein, 27 aa, Brucella spp.
YDKDSARFFVLNAINAKLTEWRATRLL

SEQ ID NO: 23716 - protein, 27 aa, Brucella spp.
GTGTGRLLELFAPLYLRGVGIDINRDM

SEQ ID NO: 23717 - protein, 20 aa, Brucella spp.
FDLVTIHQVLHFLDDPLAAI

SEQ ID NO: 23718 - protein, 18 aa, Brucella spp.
PNGRLLVVDFAPHKLEFL

SEQ ID NO: 23719 - protein, 18 aa, Brucella spp.
LVVDFAPHKLEFLREEHA

SEQ ID NO: 23720 - protein, 26 aa, Brucella spp.
EEGLTVKLWLARDPRLLIADPVSHGS

SEQ ID NO: 23721 - protein, 25 aa, Brucella spp.
ATRAITQFFFENDLYERYVERVRRA

SEQ ID NO: 23722 - protein, 27 aa, Brucella spp.
RVRRAGIYIPIVPGVLPVHNFKQVRNF

SEQ ID NO: 23723 - protein, 27 aa, Brucella spp.
ERGVQDFHFYTMNRADLPFAICHMIGI

SEQ ID NO: 23724 - protein, 31 aa, Brucella spp.
QACRDAYPRFLAWPLWLLAELAICATDLAEV

SEQ ID NO: 23725 - protein, 29 aa, Brucella spp.
RRVEALIITLLGVIALCFLTQIIMAQPQW

SEQ ID NO: 23726 - protein, 25 aa, Brucella spp.
QVVLSLQLPFAVIPLVIFTAQKKKM

SEQ ID NO: 23727 - protein, 17 aa, Brucella spp.
TAAIIVVLNLKLIYDFF

SEQ ID NO: 23728 - protein, 17 aa, Brucella spp.
VVLNLKLIYDFFTGAPI

SEQ ID NO: 23729 - protein, 18 aa, Brucella spp.
VRHVPVLIAEVIDALKPA

SEQ ID NO: 23730 - protein, 24 aa, Brucella spp.
KTGDLARIFNFLGEERHAGRIARM

SEQ ID NO: 23731 - protein, 18 aa, Brucella spp.
VVVTFHSLEDRMVKRFFA

SEQ ID NO: 23732 - protein, 24 aa, Brucella spp.
RHMPETHMRLPSFTPAVKGAVGPT

SEQ ID NO: 23733 - protein, 20 aa, Brucella spp.
PLEDDLSLFGLPKLPETNEL

SEQ ID NO: 23734 - protein, 17 aa, Brucella spp.
MIAAMLVAATVTYTIKY

SEQ ID NO: 23735 - protein, 27 aa, Brucella spp.
GNRARNRLWMAIACFAGIYGVMAGKLV

SEQ ID NO: 23736 - protein, 19 aa, Brucella spp.
VMAGKLVYFGMIGGVDQDA

SEQ ID NO: 23737 - protein, 25 aa, Brucella spp.
LKSGAGFVWIKRGLTPKQQSQIMAL

SEQ ID NO: 23738 - protein, 27 aa, Brucella spp.
DFHGKGRWLTLPEVFIFSSNIGSGREA

SEQ ID NO: 23739 - protein, 27 aa, Brucella spp.
RYSKDVRFNAFLASFPMDNPTYVVLTI

SEQ ID NO: 23740 - protein, 19 aa, Brucella spp.
PMDNPTYVVLTIIDEPKPE

SEQ ID NO: 23741 - protein, 19 aa, Brucella spp.
HVDDPRHVLAIAAAQFYGK

SEQ ID NO: 23742 - protein, 17 aa, Brucella spp.
HVLAIAAAQFYGKQPEV

SEQ ID NO: 23743 - protein, 27 aa, Brucella spp.
TSVASFTRQIWAYAGFPAANIGTTGVF

SEQ ID NO: 23744 - protein, 30 aa, Brucella spp.
DEYLGAKMRLFNALLPKGAPAIIFADDQFS

SEQ ID NO: 23745 - protein, 26 aa, Brucella spp.
VRIGEEIFEIELPLAGDFQVANALVA

SEQ ID NO: 23746 - protein, 17 aa, Brucella spp.
WLWTSDAMVEAMEGRPF

SEQ ID NO: 23747 - protein, 28 aa, Brucella spp.
NTKVPMIVVEDVLEALIRLGIAARARSK

SEQ ID NO: 23748 - protein, 25 aa, Brucella spp.
SAASFNNHWGVPLTLARMPADVDYG

SEQ ID NO: 23749 - protein, 34 aa, Brucella spp.
GEIRPLVKMVRPHVALITLIAPAHLGHFANLEEI

SEQ ID NO: 23750 - protein, 23 aa, Brucella spp.
AVAKAEIFEGIVPGGYALLNRDD

SEQ ID NO: 23751 - protein, 30 aa, Brucella spp.
PFVKQLVINLSWFFIPFAAFVMVGAGNAVN

SEQ ID NO: 23752 - protein, 24 aa, Brucella spp.
IGAGLGFLWFNAPPAAIFMGDTGS

SEQ ID NO: 23753 - protein, 28 aa, Brucella spp.
WTESQVVIRFWIVAIILAMIGLSTLKLR

SEQ ID NO: 23754 - protein, 28 aa, Brucella spp.
RQADWSQFAVFVLSPGVPLTHPQPHWSV

SEQ ID NO: 23755 - protein, 23 aa, Brucella spp.
IGTAILTLELPCADRFYVVECSS

SEQ ID NO: 23756 - protein, 17 aa, Brucella spp.
KHLDRGYFADGAKLLWA

SEQ ID NO: 23757 - protein, 28 aa, Brucella spp.
PALSSFPQNIYWIVGGVPKAGGINSLTA

SEQ ID NO: 23758 - protein, 26 aa, Brucella spp.
GGINSLTAFFPRVAKAYLIGEAAAQF

SEQ ID NO: 23759 - protein, 24 aa, Brucella spp.
PVANWWWTIDRFFLAACLALMGLG

SEQ ID NO: 23760 - protein, 23 aa, Brucella spp.
HFVERQIFFMVPAVAVMIGVSFF

SEQ ID NO: 23761 - protein, 34 aa, Brucella spp.
TTGTWGAMFFLAGLPMIWILVLGGLAICGGISAY

SEQ ID NO: 23762 - protein, 28 aa, Brucella spp.
AEEYGIILCMIIMLLFAFIVVRGLSIAL

SEQ ID NO: 23763 - protein, 30 aa, Brucella spp.
AGRNPVALLKTFWSLWQGNLDSRKLFRRLK

SEQ ID NO: 23764 - protein, 26 aa, Brucella spp.
NLDSRKLFRRLKPKLVVGFGGYPTLP

SEQ ID NO: 23765 - protein, 21 aa, Brucella spp.
KDDRFRLLVFGGSQGAQFFSQ

SEQ ID NO: 23766 - protein, 19 aa, Brucella spp.
SQGAQFFSQAIPAAVALLP

SEQ ID NO: 23767 - protein, 18 aa, Brucella spp.
QFFSQAIPAAVALLPEHE

SEQ ID NO: 23768 - protein, 21 aa, Brucella spp.
TVIGRPAMLVPFPHALDHDQA

SEQ ID NO: 23769 - protein, 19 aa, Brucella spp.
LVHFIGIGGIGMSGIAEVL

SEQ ID NO: 23770 - protein, 18 aa, Brucella spp.
PVVRRAEMLAELMRFRRA

SEQ ID NO: 23771 - protein, 23 aa, Brucella spp.
RRAEMLAELMRFRRAVAIGGTHG

SEQ ID NO: 23772 - protein, 29 aa, Brucella spp.
DAVRAAFRQFVENVPFYGFGVMCLDHPEV

SEQ ID NO: 23773 - protein, 22 aa, Brucella spp.
AIVQPHRYTRLASLFDEFAACF

SEQ ID NO: 23774 - protein, 26 aa, Brucella spp.
DTGMDKITWFRAGGPAQVLFQPSDEE

SEQ ID NO: 23775 - protein, 21 aa, Brucella spp.
PEEIPLLVVGIGSNLLVRDGG

SEQ ID NO: 23776 - protein, 25 aa, Brucella spp.
EAGLAGFHFYHGIPGGIGGALRMNA

SEQ ID NO: 23777 - protein, 24 aa, Brucella spp.
SSASPDLIFTSVLFEGVPGERDDI

SEQ ID NO: 23778 - protein, 28 aa, Brucella spp.
FENSGIRLHWEIKRLGLFREGEQIEEFL

SEQ ID NO: 23779 - protein, 34 aa, Brucella spp.
GAMNAAFVLPRFLRKPFRFAVRLFQGNVNIPRHA

SEQ ID NO: 23780 - protein, 26 aa, Brucella spp.
VGDRRWDLLLDNGVRIMLPESAPLKA

SEQ ID NO: 23781 - protein, 24 aa, Brucella spp.
LAAERHLVHSLPVGYTLDGERGIR

SEQ ID NO: 23782 - protein, 24 aa, Brucella spp.
LGVDMHVLTADAAPLRNLELCINR

SEQ ID NO: 23783 - protein, 19 aa, Brucella spp.
QYPRSVLTRIIRARVEETL

SEQ ID NO: 23784 - protein, 20 aa, Brucella spp.
RILARNVRIGRPLGIAGLPE

SEQ ID NO: 23785 - protein, 26 aa, Brucella spp.
FAATVGLLIYPQVAGIEERSVKAASS

SEQ ID NO: 23786 - protein, 23 aa, Brucella spp.
ARERGILTVGVVTKPFHFEGARR

SEQ ID NO: 23787 - protein, 34 aa, Brucella spp.
ELQKNVDTLIVIPNQNLFRIANDKTTFADAFAMA

SEQ ID NO: 23788 - protein, 24 aa, Brucella spp.
VACITDLMVKEGLINLDFADVRSV

SEQ ID NO: 23789 - protein, 17 aa, Brucella spp.
EFRQPVKPTAAQAKPMA

SEQ ID NO: 23790 - protein, 25 aa, Brucella spp.
PEFRPQSRIFQAPAPEAFERAPVAR

SEQ ID NO: 23791 - protein, 26 aa, Brucella spp.
TQDAKRRFIRILKTVRVEAGNSWGEF

SEQ ID NO: 23792 - protein, 26 aa, Brucella spp.
STARTFGFMKDVERLWAAGLALGASL

SEQ ID NO: 23793 - protein, 28 aa, Brucella spp.
TSPESAYAYYIIGLSYFRQIPDVTRDQA

SEQ ID NO: 23794 - protein, 23 aa, Brucella spp.
MQIGRYYLERKEYLAAIKRFRGV

SEQ ID NO: 23795 - protein, 23 aa, Brucella spp.
DIVLIERLDIEFRSGLSVLTGET

SEQ ID NO: 23796 - protein, 23 aa, Brucella spp.
GAGKSILLDSLSLALGARGDASL

SEQ ID NO: 23797 - protein, 23 aa, Brucella spp.
DDDGDIILRRLQMGDGRTRVFIN

SEQ ID NO: 23798 - protein, 23 aa, Brucella spp.
DGRTRVFINDQAASVALLRDLGK

SEQ ID NO: 23799 - protein, 27 aa, Brucella spp.
ASCGELSRFLLALKVALADRGSAPTLV

SEQ ID NO: 23800 - protein, 24 aa, Brucella spp.
AAPALAIFAPVVHARPMLSLDNAF

SEQ ID NO: 23801 - protein, 27 aa, Brucella spp.
KVTASRKLRFFAYAWGEMSDMPADTQL

SEQ ID NO: 23802 - protein, 36 aa, Brucella spp.
DTQLGMVEVFRQWGFPVNPLMKRFNSVDGLLAHYRA

SEQ ID NO: 23803 - protein, 25 aa, Brucella spp.
GEKQVEFFFNAEDPALCIRSPADIF

SEQ ID NO: 23804 - protein, 29 aa, Brucella spp.
AIDARREIALHRFLFGLGIRHVGEVNAKR

SEQ ID NO: 23805 - protein, 17 aa, Brucella spp.
KNSAYIFVDGRYELQVR

SEQ ID NO: 23806 - protein, 30 aa, Brucella spp.
NGKGLTIGFDPWLHTIYEAEALRNALEKQG

SEQ ID NO: 23807 - protein, 22 aa, Brucella spp.
NTPLPLSFAIIPAQGEPELFID

SEQ ID NO: 23808 - protein, 20 aa, Brucella spp.
GEAILLDPVLAAEKLRLIVT

SEQ ID NO: 23809 - protein, 17 aa, Brucella spp.
LDPVLAAEKLRLIVTSA

SEQ ID NO: 23810 - protein, 23 aa, Brucella spp.
RDGVAMVNFLSWIDAQKPGTIDE

SEQ ID NO: 23811 - protein, 24 aa, Brucella spp.
TVKAFTLVLKGVIAITTARFPKGT

SEQ ID NO: 23812 - protein, 29 aa, Brucella spp.
TRGQDIDILARIALWKHGFDYAHGTGHGV

SEQ ID NO: 23813 - protein, 26 aa, Brucella spp.
LPGGDIPMMGFETLTFCPIDRRLVDK

SEQ ID NO: 23814 - protein, 22 aa, Brucella spp.
IVVFIIVIIGAAGFNFVRDKQA

SEQ ID NO: 23815 - protein, 17 aa, Brucella spp.
GLLLAPMLVFAASAAPA

SEQ ID NO: 23816 - protein, 25 aa, Brucella spp.
FAERTSLIWKKLAITRIYDKTNNTL

SEQ ID NO: 23817 - protein, 36 aa, Brucella spp.
GDPETRIIRRVVSAALWWSKPLAWILARREIRGLKT

SEQ ID NO: 23818 - protein, 25 aa, Brucella spp.
ERRSLPSRIWLATGKKVYNFITRGI

SEQ ID NO: 23819 - protein, 21 aa, Brucella spp.
GKKVYNFITRGIFSWSDGEGT

SEQ ID NO: 23820 - protein, 28 aa, Brucella spp.
KLGIAIDISLWGRRLFFAATAGATADNT

SEQ ID NO: 23821 - protein, 20 aa, Brucella spp.
WLRRKFNVVRRFHVSTYRLV

SEQ ID NO: 23822 - protein, 31 aa, Brucella spp.
RRALNEYLRDTGLFFPIDPGANATLGGMAST

SEQ ID NO: 23823 - protein, 18 aa, Brucella spp.
DLTRLLIGAEGTLGIITE

SEQ ID NO: 23824 - protein, 29 aa, Brucella spp.
ELVNTLQMQALIMHSKLPYEAQPYLFVEF

SEQ ID NO: 23825 - protein, 21 aa, Brucella spp.
DRLWRARHEAYLASFLLRPGC

SEQ ID NO: 23826 - protein, 27 aa, Brucella spp.
GHVGDGNFHLLLLLDTDDASEMERAEA

SEQ ID NO: 23827 - protein, 25 aa, Brucella spp.
GGLLVLLLTAALVVPPFVDWSGYRA

SEQ ID NO: 23828 - protein, 24 aa, Brucella spp.
DISARLLPFPSVTFSDVRVGADAA

SEQ ID NO: 23829 - protein, 35 aa, Brucella spp.
RFSMDAELMPFLRGQLLIFDMRVERPRVTISLDKD

SEQ ID NO: 23830 - protein, 24 aa, Brucella spp.
IAIARRILEQLPIPSIPGNVDLRL

SEQ ID NO: 23831 - protein, 37 aa, Brucella spp.
SDDLSRFLSLMANRYPQLPLFRALSMRAANFPGLFDD

SEQ ID NO: 23832 - protein, 17 aa, Brucella spp.
RQGEAVLALIGLPSLPL

SEQ ID NO: 23833 - protein, 18 aa, Brucella spp.
TADLQPFIATAGYALPGF

SEQ ID NO: 23834 - protein, 17 aa, Brucella spp.
PFIATAGYALPGFGQGL

SEQ ID NO: 23835 - protein, 24 aa, Brucella spp.
FQFAKGILRFPNLVGTLNGDNISV

SEQ ID NO: 23836 - protein, 31 aa, Brucella spp.
IWPRGAFAVRPTLPLLMDMKLNVAEARMDGF

SEQ ID NO: 23837 - protein, 17 aa, Brucella spp.
FDRQPLVQFLTQRALER

SEQ ID NO: 23838 - protein, 26 aa, Brucella spp.
AQICHNTVTLMSDIVNLRQFKKQKAR

SEQ ID NO: 23839 - protein, 34 aa, Brucella spp.
LTTKKLHLRSIIHELLWFLKGDTNIAYLKENGVT

SEQ ID NO: 23840 - protein, 17 aa, Brucella spp.
ALLTMMIAQVTGLKPGE

SEQ ID NO: 23841 - protein, 25 aa, Brucella spp.
GQENDMPWRLSTDLKRFKALTLGKP

SEQ ID NO: 23842 - protein, 37 aa, Brucella spp.
RKGSNRPIYFLIGAAVLGFWLFQSVYTVQPDELAVEL

SEQ ID NO: 23843 - protein, 28 aa, Brucella spp.
EVSEPGLHFHWWPFETYEKAQIVEKQIN

SEQ ID NO: 23844 - protein, 25 aa, Brucella spp.
VNATGLYWLADDIACDIPLPLGMEA

SEQ ID NO: 23845 - protein, 23 aa, Brucella spp.
ALRERVALLKGLPLSVIDKVIST

SEQ ID NO: 23846 - protein, 17 aa, Brucella spp.
SIPLVCISGQVPTTLIG

SEQ ID NO: 23847 - protein, 17 aa, Brucella spp.
AASRLLRELVEISNFPI

SEQ ID NO: 23848 - protein, 21 aa, Brucella spp.
SRLLRELVEISNFPITSTLMG

SEQ ID NO: 23849 - protein, 24 aa, Brucella spp.
TPNKDVIMPQYAIERLYELTRNRN

SEQ ID NO: 23850 - protein, 30 aa, Brucella spp.
VGQHQMWAAQFFGFEQPNRWLTSGGLGTMG

SEQ ID NO: 23851 - protein, 30 aa, Brucella spp.
AIQHNAPIKIFILNNQYMGMVRQWQQLLHG

SEQ ID NO: 23852 - protein, 23 aa, Brucella spp.
DATTDHFILEITGKSAKIDQFIS

SEQ ID NO: 23853 - protein, 27 aa, Brucella spp.
KSAKIDQFISIMKPLGLVEICRTGVAA

SEQ ID NO: 23854 - protein, 27 aa, Brucella spp.
LKAGRSPIFRLFGYAGTGKTTLARYFA

SEQ ID NO: 23855 - protein, 29 aa, Brucella spp.
GRDLMSFGTPILVLGDPGQLPPISGGGFF

SEQ ID NO: 23856 - protein, 22 aa, Brucella spp.
RDTRERWLYTAITRAAERLIIV

SEQ ID NO: 23857 - protein, 20 aa, Brucella spp.
MLRNRRDLPWPSVTGLGRAA

SEQ ID NO: 23858 - protein, 23 aa, Brucella spp.
RPDQRHIRFSDLGDIRALIDDEY

SEQ ID NO: 23859 - protein, 26 aa, Brucella spp.
SDHGWDFMSKADFLAPIVARLKGRGM

SEQ ID NO: 23860 - protein, 18 aa, Brucella spp.
DFLAPIVARLKGRGMRVS

SEQ ID NO: 23861 - protein, 26 aa, Brucella spp.
ILGVVSLIFWALTLVVTVKYVLFVLR

SEQ ID NO: 23862 - protein, 29 aa, Brucella spp.
RKPIVRAWLWIVFPCLLLNYFGQAAFILS

SEQ ID NO: 23863 - protein, 29 aa, Brucella spp.
GEAAALPFFQMIPSFALWPMVLLATAATV

SEQ ID NO: 23864 - protein, 26 aa, Brucella spp.
MLVTTVLLYIVMTRIWNWRVSRALPI

SEQ ID NO: 23865 - protein, 29 aa, Brucella spp.
VSRALPIILGFLVIDMLFFSANIIKVHEG

SEQ ID NO: 23866 - protein, 24 aa, Brucella spp.
ATVLVLIMWTWVRGTRHLFQKTRK

SEQ ID NO: 23867 - protein, 20 aa, Brucella spp.
GMPLWQDKLFILLARTASDA

SEQ ID NO: 23868 - protein, 19 aa, Brucella spp.
KWADLMMMATPDELQADIY

SEQ ID NO: 23869 - protein, 34 aa, Brucella spp.
APEMAYFECLNEMKLIVDLIYEGGIANMNYSISN

SEQ ID NO: 23870 - protein, 25 aa, Brucella spp.
SEIRELLKLLERPDIISFAGGIPDP

SEQ ID NO: 23871 - protein, 27 aa, Brucella spp.
SEGYKPLRTWLVGELAKIGIPCTEDNV

SEQ ID NO: 23872 - protein, 23 aa, Brucella spp.
QALDYLGKLFLSPGDTALVTAPT

SEQ ID NO: 23873 - protein, 26 aa, Brucella spp.
EDAAYQYLRYNGDAIPPILALDIARN

SEQ ID NO: 23874 - protein, 21 aa, Brucella spp.
KTVIRKLVLMKQAADLHSSTI

SEQ ID NO: 23875 - protein, 26 aa, Brucella spp.
WTKPEGGMFVWVTLPEGMDGASLLAA

SEQ ID NO: 23876 - protein, 28 aa, Brucella spp.
LNAFEYGYLFKMIGYGYRHKYLIDGNDS

SEQ ID NO: 23877 - protein, 18 aa, Brucella spp.
VMDRWTLYHTRGPLERHL

SEQ ID NO: 23878 - protein, 24 aa, Brucella spp.
PLERHLCQLDYIMASPAFAAKNEH

SEQ ID NO: 23879 - protein, 18 aa, Brucella spp.
HAVPDIIRRGQPWRTIFP

SEQ ID NO: 23880 - protein, 21 aa, Brucella spp.
PDIIRRGQPWRTIFPPEQNVD

SEQ ID NO: 23881 - protein, 25 aa, Brucella spp.
AHEASVRIFTPAYELPFAGHPTVGA

SEQ ID NO: 23882 - protein, 21 aa, Brucella spp.
GTPCLLVPVHNLIAAAKVSID

SEQ ID NO: 23883 - protein, 41 aa, Brucella spp.
VGGRPLPIYVYCRETILFNSHFHARMFVIGANVYEDPATGS

SEQ ID NO: 23884 - protein, 27 aa, Brucella spp.
VDDRPIIVPMTFRFSGGSFYSFTTDGQ

SEQ ID NO: 23885 - protein, 28 aa, Brucella spp.
RLLHLEGFMIVLLVLLPFTMPGRPLLEL

SEQ ID NO: 23886 - protein, 25 aa, Brucella spp.
LSPKFVRLFLITVRYVSVFRAETGR

SEQ ID NO: 23887 - protein, 17 aa, Brucella spp.
LLIATTLCFATMAEAHR

SEQ ID NO: 23888 - protein, 23 aa, Brucella spp.
VSGIAVIIGLAGLFLWAKSRGRA

SEQ ID NO: 23889 - protein, 20 aa, Brucella spp.
LCLMWFSTAACAHFQELIPS

SEQ ID NO: 23890 - protein, 25 aa, Brucella spp.
EPGASLYFVEPQPYWEPAEKKYIVH

SEQ ID NO: 23891 - protein, 23 aa, Brucella spp.
APRPAMWFILVIGAAVSTVVMLA

SEQ ID NO: 23892 - protein, 32 aa, Brucella spp.
WDAPALTFPFVLTTWFLVLAAYAFGHLPIDSM

SEQ ID NO: 23893 - protein, 28 aa, Brucella spp.
IPTFTAPFVFVTWLFLLPKTNLEPHPHA

SEQ ID NO: 23894 - protein, 22 aa, Brucella spp.
RQERNSFALALLQPAVRGKLDR

SEQ ID NO: 23895 - protein, 27 aa, Brucella spp.
SGRLKDKMHILKLSALLASACAATLSP

SEQ ID NO: 23896 - protein, 32 aa, Brucella spp.
GFLQGSFNFALSKDFDWGKIYADGLFSRGRNQ

SEQ ID NO: 23897 - protein, 20 aa, Brucella spp.
GSDWFETRRYGVFASTEKSF

SEQ ID NO: 23898 - protein, 30 aa, Brucella spp.
NLGASYEILPDLVLRSSYATGFRAPTFNEL

SEQ ID NO: 23899 - protein, 30 aa, Brucella spp.
ATGFRAPTFNELYYPGFANPDLQPEKSRSV

SEQ ID NO: 23900 - protein, 22 aa, Brucella spp.
TSLDMALYQTRLSDAIMSTAPS

SEQ ID NO: 23901 - protein, 19 aa, Brucella spp.
MSTAPSYIPYNIASAKVTG

SEQ ID NO: 23902 - protein, 18 aa, Brucella spp.
YIPYNIASAKVTGLEATL

SEQ ID NO: 23903 - protein, 24 aa, Brucella spp.
TRRLCLAAGLALFAPLPANAADIA

SEQ ID NO: 23904 - protein, 17 aa, Brucella spp.
LFAPLPANAADIAQRVV

SEQ ID NO: 23905 - protein, 23 aa, Brucella spp.
QAEEVFLQKPDLVLAGTFSSRAT

SEQ ID NO: 23906 - protein, 18 aa, Brucella spp.
GSALLPLEKLVLEKPDIL

SEQ ID NO: 23907 - protein, 17 aa, Brucella spp.
LLPLEKLVLEKPDILVR

SEQ ID NO: 23908 - protein, 17 aa, Brucella spp.
PLEKLVLEKPDILVRSS

SEQ ID NO: 23909 - protein, 17 aa, Brucella spp.
LLLAGLALLVIVLFAVS

SEQ ID NO: 23910 - protein, 21 aa, Brucella spp.
GLSLLFPLALPLLALAGAFVS

SEQ ID NO: 23911 - protein, 17 aa, Brucella spp.
AAMEIMFWMLGSLADRS

SEQ ID NO: 23912 - protein, 29 aa, Brucella spp.
MTHVALVIPFILIGWLMLLSLGRSLDSLT

SEQ ID NO: 23913 - protein, 22 aa, Brucella spp.
DVAWPVSVHMLVSLGRSALKPV

SEQ ID NO: 23914 - protein, 24 aa, Brucella spp.
GERARVLIARVLAQDTPVILADEP

SEQ ID NO: 23915 - protein, 33 aa, Brucella spp.
FTPQRLRDVYGIRARIMMVDGEFIVHPTALQPR

SEQ ID NO: 23916 - protein, 24 aa, Brucella spp.
EPIERFAFYDRARGAFAIIRTGEK

SEQ ID NO: 23917 - protein, 25 aa, Brucella spp.
VLGIDNLVFIAILADKLPPHQRNRA

SEQ ID NO: 23918 - protein, 28 aa, Brucella spp.
VGLGLALVMRLVLLASISWIVTLREPLI

SEQ ID NO: 23919 - protein, 23 aa, Brucella spp.
FSGRDIIMLTGGLFLLGKGTMEL

SEQ ID NO: 23920 - protein, 26 aa, Brucella spp.
SSRIVHAVFWQVIVQIVVLDAVFSLD

SEQ ID NO: 23921 - protein, 25 aa, Brucella spp.
VQHLTVMMIAVILAIGVMMLASRPL

SEQ ID NO: 23922 - protein, 32 aa, Brucella spp.
VNKHPTVVILCLGFLMIIGFSLVAEGFGLHIP

SEQ ID NO: 23923 - protein, 27 aa, Brucella spp.
ILQLAEIGVILLMFGVGLHFSLKDLLS

SEQ ID NO: 23924 - protein, 17 aa, Brucella spp.
MVMALVLLPAIASVTGR

SEQ ID NO: 23925 - protein, 30 aa, Brucella spp.
LTVAKVVLFIVLMLVVGRKVIPWLLNVVAQ

SEQ ID NO: 23926 - protein, 29 aa, Brucella spp.
LPLRDAFAVLFFISVGMLFDPMSLLKDPL

SEQ ID NO: 23927 - protein, 25 aa, Brucella spp.
SLLKDPLPLLGTLAIILIGKSVAAF

SEQ ID NO: 23928 - protein, 27 aa, Brucella spp.
LAGAILSIFLNPVMFIVAERMRPWLEK

SEQ ID NO: 23929 - protein, 28 aa, Brucella spp.
DRQHGFMLFVTCVLSFTAFLFTVDFSSQ

SEQ ID NO: 23930 - protein, 18 aa, Brucella spp.
AEAAQIFQPLPALRGHFG

SEQ ID NO: 23931 - protein, 17 aa, Brucella spp.
AQIFQPLPALRGHFGSA

SEQ ID NO: 23932 - protein, 18 aa, Brucella spp.
IFQPLPALRGHFGSARAP

SEQ ID NO: 23933 - protein, 34 aa, Brucella spp.
ASDQMISLWRIVRSWWRFVVTFKLESFLAAAFFA

SEQ ID NO: 23934 - protein, 26 aa, Brucella spp.
VFLATTYFLLNYFNVLRTDIASLFQS

SEQ ID NO: 23935 - protein, 29 aa, Brucella spp.
DIASLFQSLFIVLGLVFFIHRLAVACISS

SEQ ID NO: 23936 - protein, 31 aa, Brucella spp.
VRAWPRAFRIFLILMGLLPILTALSGYIGIA

SEQ ID NO: 23937 - protein, 29 aa, Brucella spp.
MGLLSGVLLFLIGYVLTRWFQNWLDNSVM

SEQ ID NO: 23938 - protein, 22 aa, Brucella spp.
LGKPFLGAAVILTFSMGGAYAA

SEQ ID NO: 23939 - protein, 28 aa, Brucella spp.
QEDRAMVRGFLINKFRGDISLFDDSLAA

SEQ ID NO: 23940 - protein, 32 aa, Brucella spp.
LAAITRFTGWRSFGVVPWLKAVSRLPAEDSVV

SEQ ID NO: 23941 - protein, 30 aa, Brucella spp.
RGDKKALIVAVPMLPRIANFDDLDPLKAEP

SEQ ID NO: 23942 - protein, 26 aa, Brucella spp.
VFSADRFRHHFLRALGVEGGQMNYRE

SEQ ID NO: 23943 - protein, 24 aa, Brucella spp.
AERQLWWIATVVMSGLGIYLLILR

SEQ ID NO: 23944 - protein, 27 aa, Brucella spp.
VMSGLGIYLLILRHELWAKVLGLVLIV

SEQ ID NO: 23945 - protein, 26 aa, Brucella spp.
SLATNLFMWAVIGLALGWFIQHYASS

SEQ ID NO: 23946 - protein, 30 aa, Brucella spp.
HAAAGRFVLVDCLTLWITNLMMAERDMAAE

SEQ ID NO: 23947 - protein, 22 aa, Brucella spp.
GKRIALIINEFGDLGVDGGILK

SEQ ID NO: 23948 - protein, 28 aa, Brucella spp.
VIETSGLALPQPLVAAFNWPEIKTQVTV

SEQ ID NO: 23949 - protein, 23 aa, Brucella spp.
VPGKPMRLVVQAVGPRIEHYFDR

SEQ ID NO: 23950 - protein, 17 aa, Brucella spp.
RIEHYFDRPWGKDETRS

SEQ ID NO: 23951 - protein, 35 aa, Brucella spp.
ARHAKLIVVRIIGGETYWPYGLEALHACAITHGAK

SEQ ID NO: 23952 - protein, 25 aa, Brucella spp.
GERDDLWHYLIESGAANTHGFLAYC

SEQ ID NO: 23953 - protein, 19 aa, Brucella spp.
LLKAGLWWPGEAVSSLTSV

SEQ ID NO: 23954 - protein, 24 aa, Brucella spp.
APVAAIILYRALVQSGQTQPVDAL

SEQ ID NO: 23955 - protein, 26 aa, Brucella spp.
QARGLNPLPIFVSSLKDPLSAAVVDG

SEQ ID NO: 23956 - protein, 25 aa, Brucella spp.
DKRGNMVLQVIFSGTPKTVWEASQQ

SEQ ID NO: 23957 - protein, 36 aa, Brucella spp.
PENDPYFARELDAFALPLMRFGETFVGIQPARGYNI

SEQ ID NO: 23958 - protein, 30 aa, Brucella spp.
TYHSLDLVPPHGYIAYYAYLRAVAGVDAVV

SEQ ID NO: 23959 - protein, 31 aa, Brucella spp.
NCYPEAVFGPMPHIYPFIVNDPGEGTQAKRR

SEQ ID NO: 23960 - protein, 25 aa, Brucella spp.
GVDPRRLLRLKAQILDLVRDIGLDR

SEQ ID NO: 23961 - protein, 20 aa, Brucella spp.
MQIRDGLHVFGLAPQARLLT

SEQ ID NO: 23962 - protein, 25 aa, Brucella spp.
LAPQARLLTDLLVALARVPRGIPVS

SEQ ID NO: 23963 - protein, 23 aa, Brucella spp.
AGAKPDMLLAASPATWRIAGDTV

SEQ ID NO: 23964 - protein, 23 aa, Brucella spp.
TLRISGFFRDAFPEQIALFDKAV

SEQ ID NO: 23965 - protein, 22 aa, Brucella spp.
RNDLAEAWLVWGGYAYGAGEEG

SEQ ID NO: 23966 - protein, 24 aa, Brucella spp.
STAGFGMVFRALGHGMKIGVVQFV

SEQ ID NO: 23967 - protein, 19 aa, Brucella spp.
RWVLEKFPEQVTISALGEG

SEQ ID NO: 23968 - protein, 30 aa, Brucella spp.
SYDMVLCDELNIVLRYDYLPVEEVTEVLKA

SEQ ID NO: 23969 - protein, 27 aa, Brucella spp.
PALASELLLLLHVVVADGNQHPAEIAA

SEQ ID NO: 23970 - protein, 26 aa, Brucella spp.
NPAWVQLAVHYGCELRFFDASRLEDE

SEQ ID NO: 23971 - protein, 25 aa, Brucella spp.
AADLITVRGLRLIENCPVCIYAGSL

SEQ ID NO: 23972 - protein, 24 aa, Brucella spp.
SGATLVIHLSIRNLAKIESDLTPL

SEQ ID NO: 23973 - protein, 25 aa, Brucella spp.
GLRRTAMIFVGRGLDPKNFRDSALY

SEQ ID NO: 23974 - protein, 27 aa, Brucella spp.
AKRADVHFVIRMIDPPEVTLPRHCEII

SEQ ID NO: 23975 - protein, 25 aa, Brucella spp.
RDLALPVMMIARPPVAAKTVVATVP

SEQ ID NO: 23976 - protein, 26 aa, Brucella spp.
FPDPVGIILPKGEVPYFQLAYEGLGE

SEQ ID NO: 23977 - protein, 17 aa, Brucella spp.
KTWNPRLGIIGGISILG

SEQ ID NO: 23978 - protein, 17 aa, Brucella spp.
WNPRLGIIGGISILGTT

SEQ ID NO: 23979 - protein, 26 aa, Brucella spp.
DAAQALYNLPDFAILDMGDFAGGVLK

SEQ ID NO: 23980 - protein, 23 aa, Brucella spp.
GGVLKYLREHPIDRLTIAGGFAK

SEQ ID NO: 23981 - protein, 19 aa, Brucella spp.
LVWGFSQFRKDVLIEGVIL

SEQ ID NO: 23982 - protein, 25 aa, Brucella spp.
DMDALQTIWLRPKRYDAMANVARLK

SEQ ID NO: 23983 - protein, 26 aa, Brucella spp.
RDDAFAFAYMHLFEGWRRRGAEISFF

SEQ ID NO: 23984 - protein, 22 aa, Brucella spp.
AGVHHPMLGLLPLETSFARRKL

SEQ ID NO: 23985 - protein, 36 aa, Brucella spp.
ARRKLHLGYRLLEPLGGLPWDMPLKAHEFHYASIVR

SEQ ID NO: 23986 - protein, 23 aa, Brucella spp.
GINPEHFPLPEFSPEIWNRLPDE

SEQ ID NO: 23987 - protein, 27 aa, Brucella spp.
PGTQALIQLMPMLAAPSTVAILGPTYQ

SEQ ID NO: 23988 - protein, 17 aa, Brucella spp.
VVLKSFGKFFGLAGIRL

SEQ ID NO: 23989 - protein, 27 aa, Brucella spp.
ALCERHILVRKFDYAPDWLRIGLAHDD

SEQ ID NO: 23990 - protein, 33 aa, Brucella spp.
SLALLLDRFIGDLPLLWQRISHPVVLLGKAISW

SEQ ID NO: 23991 - protein, 27 aa, Brucella spp.
DGIVAPAFWFLVGGLPGLFAYKFINTA

SEQ ID NO: 23992 - protein, 25 aa, Brucella spp.
DIDAALVLFWSTMSLMTGLVIAASL

SEQ ID NO: 23993 - protein, 32 aa, Brucella spp.
ALETALPILSQRNIPIIISDVSELTLAERRAA

SEQ ID NO: 23994 - protein, 25 aa, Brucella spp.
ATGSFLGSLWRAQPFAIIDDGTIEG

SEQ ID NO: 23995 - protein, 20 aa, Brucella spp.
AALNYPLVIAGGSLLDAAPG

SEQ ID NO: 23996 - protein, 23 aa, Brucella spp.
EQKQPIINLLRSGSFETALGTIK

SEQ ID NO: 23997 - protein, 26 aa, Brucella spp.
VSAPTISLPRFTPTSYVDPALAQPCI

SEQ ID NO: 23998 - protein, 25 aa, Brucella spp.
TAAANKYFLPERVISAVNSRPGAGG

SEQ ID NO: 23999 - protein, 17 aa, Brucella spp.
ILVLAEAALPTTRQIAA

SEQ ID NO: 24000 - protein, 17 aa, Brucella spp.
ADKTFAHFGEALRALYE

SEQ ID NO: 24001 - protein, 19 aa, Brucella spp.
LCAAGIVIRALAPLLQNKR

SEQ ID NO: 24002 - protein, 19 aa, Brucella spp.
IVIRALAPLLQNKRMEPPV

SEQ ID NO: 24003 - protein, 25 aa, Brucella spp.
SGELRFGINLLHPPSDLTLANPDDA

SEQ ID NO: 24004 - protein, 23 aa, Brucella spp.
RTNELIYHPQCVAIGIETPDESL

SEQ ID NO: 24005 - protein, 26 aa, Brucella spp.
APLGHDFCIISLSDNLKPWDIIEKRL

SEQ ID NO: 24006 - protein, 18 aa, Brucella spp.
NLKPWDIIEKRLALAAEA

SEQ ID NO: 24007 - protein, 22 aa, Brucella spp.
EADLAMAFYNPISKARPHQLGR

SEQ ID NO: 24008 - protein, 28 aa, Brucella spp.
DYLSPEQVLLPLIYPVTTEKLPDHMDYE

SEQ ID NO: 24009 - protein, 25 aa, Brucella spp.
IAEGDPFFYGSFMYIHDRLAEKYET

SEQ ID NO: 24010 - protein, 25 aa, Brucella spp.
SAAALDLWLPHIEGSIVAIGNAPTA

SEQ ID NO: 24011 - protein, 27 aa, Brucella spp.
GNAPTALFRLFELLDAGAPKPALIIGM

SEQ ID NO: 24012 - protein, 32 aa, Brucella spp.
IAANNVPPFIDALLRCFLRNGAARMKQLTSER

SEQ ID NO: 24013 - protein, 30 aa, Brucella spp.
QLDSNHYIGAMPLLGRLTPLQLRELARLAQ

SEQ ID NO: 24014 - protein, 28 aa, Brucella spp.
LAQEELRLTPWQGILLPNIAPGETDRIK

SEQ ID NO: 24015 - protein, 18 aa, Brucella spp.
RRGRPIVVLASGDPMFFG

SEQ ID NO: 24016 - protein, 24 aa, Brucella spp.
FSPDEMLVLPYPSSLSLAAARMGW

SEQ ID NO: 24017 - protein, 29 aa, Brucella spp.
VHGRPFELLVPHILPGVRLLVLSNDGTTP

SEQ ID NO: 24018 - protein, 21 aa, Brucella spp.
SEMRLFAWRQEFGGDLTRVGV

SEQ ID NO: 24019 - protein, 29 aa, Brucella spp.
PDALADYELLELLLFRAIRRADTKPIAKA

SEQ ID NO: 24020 - protein, 27 aa, Brucella spp.
AFETREQFRILFLDKKNKLIADEVQQT

SEQ ID NO: 24021 - protein, 26 aa, Brucella spp.
TNEIDRFVFEFGMDHDAFPATLNYRG

SEQ ID NO: 24022 - protein, 28 aa, Brucella spp.
VEIKEGMIFTIEPMINLGKPHVKVLADG

SEQ ID NO: 24023 - protein, 21 aa, Brucella spp.
LERRYKRFLADVTLDDGRFIT

SEQ ID NO: 24024 - protein, 25 aa, Brucella spp.
YVEVKNVHFIRTPGLAEFPDTVTAR

SEQ ID NO: 24025 - protein, 24 aa, Brucella spp.
AGHRGIMLFITQRADCSRFGISGD

SEQ ID NO: 24026 - protein, 20 aa, Brucella spp.
ANFLLAAMAAAMLTACAGGK

SEQ ID NO: 24027 - protein, 18 aa, Brucella spp.
GVYPKFGHLPKAATAQIT

SEQ ID NO: 24028 - protein, 22 aa, Brucella spp.
LNKVLNLNCVYAASPPSPAHGD

SEQ ID NO: 24029 - protein, 25 aa, Brucella spp.
SSALMARFLKHYGVQHSIYIPDRIF

SEQ ID NO: 24030 - protein, 24 aa, Brucella spp.
GVQHSIYIPDRIFEGYGPNPDAMR

SEQ ID NO: 24031 - protein, 17 aa, Brucella spp.
QQGHLCAAGVVFLALVQ

SEQ ID NO: 24032 - protein, 28 aa, Brucella spp.
GHLCAAGVVFLALVQVAKILRARGKGPG

SEQ ID NO: 24033 - protein, 26 aa, Brucella spp.
GPGPDLLSMLDLVALATVCDVVPLKG

SEQ ID NO: 24034 - protein, 27 aa, Brucella spp.
RIGEPLNAFHLGYLIGPRINAGGRIGD

SEQ ID NO: 24035 - protein, 24 aa, Brucella spp.
VTASDRWHPGIVGLLASRLKEKAR

SEQ ID NO: 24036 - protein, 21 aa, Brucella spp.
HPQPLLALPHHVLADVRGVGR

SEQ ID NO: 24037 - protein, 17 aa, Brucella spp.
ALPHHVLADVRGVGRDH

SEQ ID NO: 24038 - protein, 25 aa, Brucella spp.
AEGDLGRFLFNNIGCSVHVAGNLSL

SEQ ID NO: 24039 - protein, 25 aa, Brucella spp.
RLAAIFQLDRWLSILEMPLKITMKA

SEQ ID NO: 24040 - protein, 24 aa, Brucella spp.
EVSGHIKWFDVAKGYGFIVPDQPG

SEQ ID NO: 24041 - protein, 24 aa, Brucella spp.
GLERVIVKWFNRTKGFGFLTRGEG

SEQ ID NO: 24042 - protein, 25 aa, Brucella spp.
EGTEDIFIHMETLRRFGMMELRPGQ

SEQ ID NO: 24043 - protein, 21 aa, Brucella spp.
KDRAMIFILGEMRRIVMWMQN

SEQ ID NO: 24044 - protein, 27 aa, Brucella spp.
ILGEMRRIVMWMQNTPLPLDMVFLDDK

SEQ ID NO: 24045 - protein, 42 aa, Brucella spp.
AGEGDPILLIHGFASSSLVNWVSPGWFRTLTEAGYRVIAIDN

SEQ ID NO: 24046 - protein, 22 aa, Brucella spp.
NDPVLGAFLYATILNQPSLEEA

SEQ ID NO: 24047 - protein, 17 aa, Brucella spp.
FLYATILNQPSLEEAVM

SEQ ID NO: 24048 - protein, 32 aa, Brucella spp.
RDPAYSRFMDPVLYLKGFHAIQTHRLAHWLYK

SEQ ID NO: 24049 - protein, 27 aa, Brucella spp.
HAIQTHRLAHWLYKQGRKDFAYYLQSR

SEQ ID NO: 24050 - protein, 25 aa, Brucella spp.
VVGENAGFWFGAVLRGDNEPITIGA

SEQ ID NO: 24051 - protein, 26 aa, Brucella spp.
NVQEQTIMHTDIGFPLTIGAGCTIGH

SEQ ID NO: 24052 - protein, 23 aa, Brucella spp.
RQDFEFMMNFALIPARFSMASGF

SEQ ID NO: 24053 - protein, 26 aa, Brucella spp.
RIGAVRMILFWVFTSVVAGLTHYALH

SEQ ID NO: 24054 - protein, 29 aa, Brucella spp.
TLTLKPVLIFVGVWFLINIVTGLYSTGGA

SEQ ID NO: 24055 - protein, 23 aa, Brucella spp.
PQRKILRMRATRNGFARLEIGEA

SEQ ID NO: 24056 - protein, 18 aa, Brucella spp.
LPFPVEIVDPRDIDKETG

SEQ ID NO: 24057 - protein, 33 aa, Brucella spp.
LRTRKLSELRESPLLLVLDQVTDPHNVGAIMRS

SEQ ID NO: 24058 - protein, 19 aa, Brucella spp.
IEELHTLGFQTIGLDSQGP

SEQ ID NO: 24059 - protein, 27 aa, Brucella spp.
KVDAERKFFPGYVLVRAKLTDSVFSLI

SEQ ID NO: 24060 - protein, 36 aa, Brucella spp.
GSPIPVLITYYQDKSFTFVMKTPPVTYFLKKAANLK

SEQ ID NO: 24061 - protein, 17 aa, Brucella spp.
VGAEELFEIVNGGKIEF

SEQ ID NO: 24062 - protein, 34 aa, Brucella spp.
GGKIEFDRCIATPDMMPLVGRLGKVLGPRGMMPN

SEQ ID NO: 24063 - protein, 18 aa, Brucella spp.
FVAWLNGAFKESGSVVVA

SEQ ID NO: 24064 - protein, 18 aa, Brucella spp.
KANDKLVILGGAMGATTL

SEQ ID NO: 24065 - protein, 23 aa, Brucella spp.
LRAKLVGMIQTPAQRLAVLTSAP

SEQ ID NO: 24066 - protein, 24 aa, Brucella spp.
AVFKSVFPIQDFSGASMLEFVRYE

SEQ ID NO: 24067 - protein, 25 aa, Brucella spp.
GASMLEFVRYEFDPPKFDVDECRQR

SEQ ID NO: 24068 - protein, 25 aa, Brucella spp.
TYSAPLKVTLRLIVFDIDEDTGAKS

SEQ ID NO: 24069 - protein, 30 aa, Brucella spp.
HSSGKLLFAARVIPYRGSWLDIEFDSKDIV

SEQ ID NO: 24070 - protein, 23 aa, Brucella spp.
QEALFDIYRVMRPGEPPTMDSAE

SEQ ID NO: 24071 - protein, 26 aa, Brucella spp.
MDSAEAMFHSLFFDSERYDLSAVGRV

SEQ ID NO: 24072 - protein, 24 aa, Brucella spp.
EDTVRVLRKEDILAVVKMLVELRD

SEQ ID NO: 24073 - protein, 25 aa, Brucella spp.
DVSPKQLVSVAAALIPFLENDDANR

SEQ ID NO: 24074 - protein, 32 aa, Brucella spp.
DLGDLALGRNVLVAFMPWNGYNYEDSILLSEK

SEQ ID NO: 24075 - protein, 29 aa, Brucella spp.
TRELMTEYPRSQWWQFAVEDEKLQGELEA

SEQ ID NO: 24076 - protein, 17 aa, Brucella spp.
THADIVLNPLGVPSRMN

SEQ ID NO: 24077 - protein, 17 aa, Brucella spp.
LMLANQVKRGVSIATPV

SEQ ID NO: 24078 - protein, 32 aa, Brucella spp.
GEPFDRQVTMGYIYMLKLHHLVDDKIHARSIG

SEQ ID NO: 24079 - protein, 24 aa, Brucella spp.
PERDGLFCARIFGPIKDYECLCGK

SEQ ID NO: 24080 - protein, 29 aa, Brucella spp.
IELAAPVAHIWFLKSLPSRIGTLLDMTLK

SEQ ID NO: 24081 - protein, 26 aa, Brucella spp.
LKDIERVLYFENYIVTEPGLTSLKEH

SEQ ID NO: 24082 - protein, 35 aa, Brucella spp.
LESGNRPEWMIMKIVPVIPPDLRPLVPLDGGRFAT

SEQ ID NO: 24083 - protein, 18 aa, Brucella spp.
DLRPLVPLDGGRFATSDL

SEQ ID NO: 24084 - protein, 25 aa, Brucella spp.
NNRLKRLIELRAPGIIIRNEKRMLQ

SEQ ID NO: 24085 - protein, 32 aa, Brucella spp.
CGLPKKMALELFKPFIYARLDAKGYSSTVKQA

SEQ ID NO: 24086 - protein, 18 aa, Brucella spp.
MMSTNNILHPANGAPIIV

SEQ ID NO: 24087 - protein, 27 aa, Brucella spp.
IVPSQDMVLGLYYLSIVAEKEPGEGMI

SEQ ID NO: 24088 - protein, 17 aa, Brucella spp.
TTPGRMIMGELLPKNVN

SEQ ID NO: 24089 - protein, 19 aa, Brucella spp.
GRMIMGELLPKNVNVPFDI

SEQ ID NO: 24090 - protein, 25 aa, Brucella spp.
GQKETVIFCDRIMQLGFAHACRAGI

SEQ ID NO: 24091 - protein, 18 aa, Brucella spp.
GGDARFLLSVESILSVEP

SEQ ID NO: 24092 - protein, 19 aa, Brucella spp.
ARFLLSVESILSVEPGAHV

SEQ ID NO: 24093 - protein, 18 aa, Brucella spp.
TIEPVEYLIPKGKPFHLQ

SEQ ID NO: 24094 - protein, 17 aa, Brucella spp.
EYLIPKGKPFHLQDGDV

SEQ ID NO: 24095 - protein, 25 aa, Brucella spp.
PKFGDLVITKFMNAVMLHGKKSVAE

SEQ ID NO: 24096 - protein, 28 aa, Brucella spp.
RPERRQALAIRWLINAARGRNETTMVDR

SEQ ID NO: 24097 - protein, 24 aa, Brucella spp.
KTTMTERILFYTGKNHKIGETHDG

SEQ ID NO: 24098 - protein, 23 aa, Brucella spp.
AEKYHVPRMVFVNKMDKIGADFY

SEQ ID NO: 24099 - protein, 22 aa, Brucella spp.
TIEVKFHPILCGTAFKNRGVQP

SEQ ID NO: 24100 - protein, 17 aa, Brucella spp.
PLLDAVVEFLPAPTDVP

SEQ ID NO: 24101 - protein, 34 aa, Brucella spp.
DEAPLSMLAFKIMNDPFVGSLTFTRIYSGKLTKG

SEQ ID NO: 24102 - protein, 25 aa, Brucella spp.
CDPLKPVILERMEFPDPVIEIAIEP

SEQ ID NO: 24103 - protein, 18 aa, Brucella spp.
GELHLDILVDRMKREFKV

SEQ ID NO: 24104 - protein, 24 aa, Brucella spp.
FARVKIIFEPHDGDDFIFESKIVG

SEQ ID NO: 24105 - protein, 23 aa, Brucella spp.
AGPLAGFPMLGVKATLIDGAYHD

SEQ ID NO: 24106 - protein, 23 aa, Brucella spp.
VNAMVPLANMFGYVNSLRSMSQG

SEQ ID NO: 24107 - protein, 20 aa, Brucella spp.
FEMRTHKRLLDIVDPTPQTV

SEQ ID NO: 24108 - protein, 24 aa, Brucella spp.
PKAKLAEFRVSPDNLLEVGVEITA

SEQ ID NO: 24109 - protein, 24 aa, Brucella spp.
DSDRGLILVRGAVPGSKGAWILVR

SEQ ID NO: 24110 - protein, 27 aa, Brucella spp.
VPGSKGAWILVRDAVKASLPENAPKPA

SEQ ID NO: 24111 - protein, 28 aa, Brucella spp.
LDPRDDILQRVVRWQLARRQQGSHKAQG

SEQ ID NO: 24112 - protein, 24 aa, Brucella spp.
HKRSYRFIDFKRRKLDVVGTVERL

SEQ ID NO: 24113 - protein, 31 aa, Brucella spp.
EYDPNRTAFIALIRYTDGELAYILAPQRLAV

SEQ ID NO: 24114 - protein, 26 aa, Brucella spp.
GAEIARMEWYREGRVPLHTLRADIDY

SEQ ID NO: 24115 - protein, 26 aa, Brucella spp.
YGICGVKVWVFKGEILEHDPMASERR

SEQ ID NO: 24116 - protein, 28 aa, Brucella spp.
HMKRAGRVWIRIFPDLPVTSKPTEVRMG

SEQ ID NO: 24117 - protein, 24 aa, Brucella spp.
SGARRVMCIKVLGGSKRRYASVGD

SEQ ID NO: 24118 - protein, 18 aa, Brucella spp.
ELRAKNHMKIISLAPEVL

SEQ ID NO: 24119 - protein, 25 aa, Brucella spp.
ISKEAPIHLSNLAIADPKDGKPTRV

SEQ ID NO: 24120 - protein, 29 aa, Brucella spp.
TLRQDRMYEFLDRLITIALPRVRDFRGLN

SEQ ID NO: 24121 - protein, 24 aa, Brucella spp.
AEIEIELKYYEGVPVIREITRVSK

SEQ ID NO: 24122 - protein, 17 aa, Brucella spp.
KPGRRVYVSVKSIPQVV

SEQ ID NO: 24123 - protein, 17 aa, Brucella spp.
GRRVYVSVKSIPQVVNG

SEQ ID NO: 24124 - protein, 30 aa, Brucella spp.
EARSKWGMSRTMISNIFVGVKDGFEKKLEI

SEQ ID NO: 24125 - protein, 17 aa, Brucella spp.
GFSHEVVYDVPAGITVA

SEQ ID NO: 24126 - protein, 32 aa, Brucella spp.
KAGVKDVVFDRGAFIYHGRVKALAEAAREGGL

SEQ ID NO: 24127 - protein, 20 aa, Brucella spp.
KGGRRFGFAALVVVGDQKGR

SEQ ID NO: 24128 - protein, 26 aa, Brucella spp.
EAAKRDMIFVPLRSGRTLHHDVEGRH

SEQ ID NO: 24129 - protein, 17 aa, Brucella spp.
LLRAAPAGKGIIAGGPM

SEQ ID NO: 24130 - protein, 36 aa, Brucella spp.
FEGGQMPIYRRLPKRGFTNIFAKSFNVVSLGRIQAA

SEQ ID NO: 24131 - protein, 26 aa, Brucella spp.
AEELKKRIWFTLGALLVYRFGTYIPL

SEQ ID NO: 24132 - protein, 37 aa, Brucella spp.
LGHGQPLYMLFYAALMAFFCFFYTAIVFNPKDTADQL

SEQ ID NO: 24133 - protein, 25 aa, Brucella spp.
VVGAIYIVLVCLLPEFLISATGVPF

SEQ ID NO: 24134 - protein, 26 aa, Brucella spp.
APDCANGFILDGYPRTVPQAQALSQM

SEQ ID NO: 24135 - protein, 23 aa, Brucella spp.
GTGELRIINGMAPVEEVTAEIER

SEQ ID NO: 24136 - protein, 27 aa, Brucella spp.
NKRVNIALQYIHGIGPKFAREIVTKVG

SEQ ID NO: 24137 - protein, 31 aa, Brucella spp.
ESALRALQAAGFVITSIRDVTPIPHNGCRPR

SEQ ID NO: 24138 - protein, 18 aa, Brucella spp.
ALRRVLLSSLRGAAVTAV

SEQ ID NO: 24139 - protein, 25 aa, Brucella spp.
AEDAPIGLIPVDSLYSPVRKVSYKI

SEQ ID NO: 24140 - protein, 26 aa, Brucella spp.
AVAYAARILQDQLSIFVNFEEPQKEA

SEQ ID NO: 24141 - protein, 25 aa, Brucella spp.
VLASMGLHLGMEIPAWPPENIEDLA

SEQ ID NO: 24142 - protein, 22 aa, Brucella spp.
SHRKAMFANMAASLIEHEQIVT

SEQ ID NO: 24143 - protein, 25 aa, Brucella spp.
AIRDVRLVAKLFDTLAARYATRNGG

SEQ ID NO: 24144 - protein, 17 aa, Brucella spp.
AFFSLAAGPVAAQDSPA

SEQ ID NO: 24145 - protein, 26 aa, Brucella spp.
SPFEGDPFFEQFFGSQFGASKPRIQQ

SEQ ID NO: 24146 - protein, 27 aa, Brucella spp.
QVGISDFDFFIQTDAAINPGNSGGALI

SEQ ID NO: 24147 - protein, 17 aa, Brucella spp.
QGSTRFERPYIGATFQG

SEQ ID NO: 24148 - protein, 22 aa, Brucella spp.
DNHFMLKKTGIALICATFLAGC

SEQ ID NO: 24149 - protein, 25 aa, Brucella spp.
TRNGDRIILNMPSNITFDTDQDQVK

SEQ ID NO: 24150 - protein, 25 aa, Brucella spp.
DQVKSQFYPTLNSVAIVLRKFDKTL

SEQ ID NO: 24151 - protein, 31 aa, Brucella spp.
GSISRSNCMVIFINQIRMKIGVMFGSPETTT

SEQ ID NO: 24152 - protein, 19 aa, Brucella spp.
PFKQVEFDIMYGAGVSKVG

SEQ ID NO: 24153 - protein, 24 aa, Brucella spp.
PRNDPTLMFTNAGMVQFKNVFTGL

SEQ ID NO: 24154 - protein, 27 aa, Brucella spp.
YTARHHTFFEMLGNFSFGDYFKEDAIS

SEQ ID NO: 24155 - protein, 17 aa, Brucella spp.
ITREFGLPKDKLLVTVY

SEQ ID NO: 24156 - protein, 24 aa, Brucella spp.
LSDDRIIRIPTSDNFWAMGDTGPC

SEQ ID NO: 24157 - protein, 33 aa, Brucella spp.
PEEDGDRFIEIWNLVFMQFEQQTPELRIDLPRP

SEQ ID NO: 24158 - protein, 18 aa, Brucella spp.
YVLRRIMRRAMRHAQLLG

SEQ ID NO: 24159 - protein, 29 aa, Brucella spp.
QLLGAKEPLMWRLLPALIREMGQAYPELI

SEQ ID NO: 24160 - protein, 23 aa, Brucella spp.
GETAFKLYDTYGFPLDLTQDALR

SEQ ID NO: 24161 - protein, 36 aa, Brucella spp.
DGDEMTRIIWQFIKDKLIHPYLDIDLKYYDLSVENR

SEQ ID NO: 24162 - protein, 24 aa, Brucella spp.
FEEKKIWYEHRLIDDMVASALKWS

SEQ ID NO: 24163 - protein, 17 aa, Brucella spp.
FMTKDLALLIGPDQPWL

SEQ ID NO: 24164 - protein, 28 aa, Brucella spp.
VTSVRLENFFWWTLEDIAARDNLTVSRL

SEQ ID NO: 24165 - protein, 26 aa, Brucella spp.
PILAEGPAIILVNPQLPENIGMVARA

SEQ ID NO: 24166 - protein, 25 aa, Brucella spp.
LADELLTFPVNPAFASLNIAQAVLL

SEQ ID NO: 24167 - protein, 28 aa, Brucella spp.
AFASLNIAQAVLLMSYEWMKSGLENQTD

SEQ ID NO: 24168 - protein, 24 aa, Brucella spp.
MPDRRFVYIADDAGFPYGNWEEEA

SEQ ID NO: 24169 - protein, 17 aa, Brucella spp.
LKRRIIELFGEFIANYD

SEQ ID NO: 24170 - protein, 18 aa, Brucella spp.
RRIIELFGEFIANYDPEI

SEQ ID NO: 24171 - protein, 32 aa, Brucella spp.
IVVLACTHYPFLVNVLRRLAPWPVDWLDPAEA

SEQ ID NO: 24172 - protein, 17 aa, Brucella spp.
FFRIGTGGTAGTYYPIG

SEQ ID NO: 24173 - protein, 27 aa, Brucella spp.
KGKVEDLRLLATLYPETIHIVARKDAN

SEQ ID NO: 24174 - protein, 25 aa, Brucella spp.
KDGALDAYFFVGGYPTGAISELAIS

SEQ ID NO: 24175 - protein, 19 aa, Brucella spp.
ILEKYSFFSKDVVPAGAYK

SEQ ID NO: 24176 - protein, 25 aa, Brucella spp.
AKQPDDLIYNITKVLWNEDTRKALD

SEQ ID NO: 24177 - protein, 22 aa, Brucella spp.
TLLIILSLFHYYTAGFGLLPEM

SEQ ID NO: 24178 - protein, 26 aa, Brucella spp.
MIHRGIHLAFVLGLVFLVFPFSRKGY

SEQ ID NO: 24179 - protein, 29 aa, Brucella spp.
VGWPLPIISVLFMLYALYGPSMPGILVHP

SEQ ID NO: 24180 - protein, 24 aa, Brucella spp.
VVATYVFHFVLFGVFATRIGLGQL

SEQ ID NO: 24181 - protein, 26 aa, Brucella spp.
MGAAAFLMIEFLNLPYTTIILAAIVP

SEQ ID NO: 24182 - protein, 17 aa, Brucella spp.
RDWPTIIPLVVLIAVLL

SEQ ID NO: 24183 - protein, 26 aa, Brucella spp.
EPIVAHFFVFYYGVLADITPPVALAA

SEQ ID NO: 24184 - protein, 26 aa, Brucella spp.
LGKVLVPFVFVFSPSLLLVTSNFNWP

SEQ ID NO: 24185 - protein, 24 aa, Brucella spp.
VGGFKLYMVEFVTEGEERITVRIE

SEQ ID NO: 24186 - protein, 25 aa, Brucella spp.
SVEDMKILFDGIPLEKISVSMTMNG

SEQ ID NO: 24187 - protein, 30 aa, Brucella spp.
NDILKEFMVRNTYIYPPEPSMRIIADIIAY

SEQ ID NO: 24188 - protein, 43 aa, Brucella spp.
VDDFAGRLSFFFAIGMNFFMEIAKLRAARLLWSRIMKEFDPKK

SEQ ID NO: 24189 - protein, 17 aa, Brucella spp.
LLWSRIMKEFDPKKPGS

SEQ ID NO: 24190 - protein, 18 aa, Brucella spp.
PRQDYQYLFDHGVAAVFG

SEQ ID NO: 24191 - protein, 25 aa, Brucella spp.
PSNQSYIVIDKILAAIKEIGADAVH

SEQ ID NO: 24192 - protein, 25 aa, Brucella spp.
SFGDDRIFIEKFVTQPRHIEIQVLG

SEQ ID NO: 24193 - protein, 28 aa, Brucella spp.
FIVDGNRNFYFLEMNTRLQVEHPVTELI

SEQ ID NO: 24194 - protein, 26 aa, Brucella spp.
LYAEDPYRNFLPSIGRLTRYRPPVEG

SEQ ID NO: 24195 - protein, 26 aa, Brucella spp.
EGGEISMYYDPMIAKLCTWGPDRISA

SEQ ID NO: 24196 - protein, 23 aa, Brucella spp.
IANDWVVTLDGYSLPVRIAEGEG

SEQ ID NO: 24197 - protein, 23 aa, Brucella spp.
SGTGWRLRWRGMDVVAHVRKPRV

SEQ ID NO: 24198 - protein, 26 aa, Brucella spp.
PDTSKMLLCPMPGVITSILVKDGETV

SEQ ID NO: 24199 - protein, 18 aa, Brucella spp.
IIGLVIVAALGAVPFAAE

SEQ ID NO: 24200 - protein, 18 aa, Brucella spp.
CMGVDVIAHYKLPFGNTL

SEQ ID NO: 24201 - protein, 25 aa, Brucella spp.
MVPKRIDELLEGSSLYWVIKGNVQC

SEQ ID NO: 24202 - protein, 23 aa, Brucella spp.
KIVPTEWQPRRAFQGWRYLNENE

SEQ ID NO: 24203 - protein, 26 aa, Brucella spp.
RHHEYATLEHLLLALIDDQDAGAVMR

SEQ ID NO: 24204 - protein, 19 aa, Brucella spp.
TIFSLDMGTLLAGTRYRGD

SEQ ID NO: 24205 - protein, 17 aa, Brucella spp.
FPGAVLFIDEIHTVIGA

SEQ ID NO: 24206 - protein, 18 aa, Brucella spp.
IMKGLKPYFEDFHKVKYT

SEQ ID NO: 24207 - protein, 28 aa, Brucella spp.
EIEKAHPDLFNILLQVMDHGALTDHNGK

SEQ ID NO: 24208 - protein, 25 aa, Brucella spp.
HNGKKIDFRNVILIMTTNAGASDMA

SEQ ID NO: 24209 - protein, 46 aa, Brucella spp.
NRLFTPEFRNRLDAIIPFGPLPVPVIHQVVQKFVLQLEAQLAERGV

SEQ ID NO: 24210 - protein, 17 aa, Brucella spp.
FELTDAAIAWLADKGYD

SEQ ID NO: 24211 - protein, 27 aa, Brucella spp.
LHRTDQQFHFINNGFLSYDDFLNELVS

SEQ ID NO: 24212 - protein, 28 aa, Brucella spp.
DLTEAIWDDFFSFYMDTGSRKWGRPYLN

SEQ ID NO: 24213 - protein, 24 aa, Brucella spp.
KWGRPYLNREFFSLIGQSMADDIL

SEQ ID NO: 24214 - protein, 25 aa, Brucella spp.
IEDHPFLHFEVCYHQAIDFAIEHKL

SEQ ID NO: 24215 - protein, 22 aa, Brucella spp.
HVPTLRQMLDLVDGRVPLVIEL

SEQ ID NO: 24216 - protein, 20 aa, Brucella spp.
MSFDHHLIRRFTADAPGIPG

SEQ ID NO: 24217 - protein, 35 aa, Brucella spp.
FVSYNVHHLPNPFVTFVRERLQIPVISWTVRDREM

SEQ ID NO: 24218 - protein, 24 aa, Brucella spp.
ASGATVFMWAGFAGAASAASAVRL

SEQ ID NO: 24219 - protein, 17 aa, Brucella spp.
LVPHRAIYDLTLDRADE

SEQ ID NO: 24220 - protein, 29 aa, Brucella spp.
KEQQDGMPIYRINFKLYRNGITRDLTMDY

SEQ ID NO: 24221 - protein, 26 aa, Brucella spp.
FGHQTHRWNPKMAPFIYGERNNIHIL

SEQ ID NO: 24222 - protein, 26 aa, Brucella spp.
YGERNNIHILDLSQTVPLLNSALKVV

SEQ ID NO: 24223 - protein, 19 aa, Brucella spp.
QYYVNARWLGGMMTNWKTI

SEQ ID NO: 24224 - protein, 26 aa, Brucella spp.
MGSVPDLMFIIDTNKEAIAIQEAKRL

SEQ ID NO: 24225 - protein, 33 aa, Brucella spp.
VEGRMRKFYEEVVLLSQAFVINPDLTVEAALKD

SEQ ID NO: 24226 - protein, 18 aa, Brucella spp.
RVLLKASGEALMGSQGFG

SEQ ID NO: 24227 - protein, 22 aa, Brucella spp.
GDHMGMLATVINSLALRTSLHK

SEQ ID NO: 24228 - protein, 25 aa, Brucella spp.
MDEGKVVIFAGGTGNPFFTTDSAAA

SEQ ID NO: 24229 - protein, 27 aa, Brucella spp.
ALARENNILIIVYSIHENGGLADILQG

SEQ ID NO: 24230 - protein, 22 aa, Brucella spp.
ASLLEPITIEAYGSTMPINQVA

SEQ ID NO: 24231 - protein, 30 aa, Brucella spp.
LGLNPITDGMTLRIRLPELNEQRRKELVKI

SEQ ID NO: 24232 - protein, 24 aa, Brucella spp.
LGTITLWLTWVGGVGFTLFSIAIG

SEQ ID NO: 24233 - protein, 30 aa, Brucella spp.
TAFSRLFGWAWLIVTGILLILDRGALLTIG

SEQ ID NO: 24234 - protein, 22 aa, Brucella spp.
PFGFTTIVFLFAVVWSTDIAAY

SEQ ID NO: 24235 - protein, 25 aa, Brucella spp.
DAAVKRLFAMGLFSDVRIHQSGSTL

SEQ ID NO: 24236 - protein, 27 aa, Brucella spp.
ADEETLRRFYYNRGYADFRVLSSNAVL

SEQ ID NO: 24237 - protein, 27 aa, Brucella spp.
RAKRRLEVLDFFQTVNISTAPGSEPDQ

SEQ ID NO: 24238 - protein, 31 aa, Brucella spp.
MRNYGLSFTEPYFLGYRLSAGFDVFRRSYRV

SEQ ID NO: 24239 - protein, 23 aa, Brucella spp.
AAENSPWLRSSVSYSLTYSSIDD

SEQ ID NO: 24240 - protein, 25 aa, Brucella spp.
DDGVRIFDLFKNSSDIIRGFKFNGI

SEQ ID NO: 24241 - protein, 25 aa, Brucella spp.
SGTAEVQFPMPVLPESLGVRGAFFA

SEQ ID NO: 24242 - protein, 35 aa, Brucella spp.
RASVGVSLMWASPFGPLRFDYAFPVAKADTDKVQN

SEQ ID NO: 24243 - protein, 29 aa, Brucella spp.
PHRDFSAVGRMLFPASVRPESWLGETGIS

SEQ ID NO: 24244 - protein, 26 aa, Brucella spp.
IPARPIKQWFRDIANIRSIGQSRKDA

SEQ ID NO: 24245 - protein, 26 aa, Brucella spp.
LLAVLPHRYPFLLIDRIVDIDGDVSA

SEQ ID NO: 24246 - protein, 17 aa, Brucella spp.
PGVVYFMTIDSAKFRRP

SEQ ID NO: 24247 - protein, 17 aa, Brucella spp.
VVYFMTIDSAKFRRPVV

SEQ ID NO: 24248 - protein, 21 aa, Brucella spp.
AVHQFVRVGHHAFIGGLAAVV

SEQ ID NO: 24249 - protein, 24 aa, Brucella spp.
AVVSDLIPYGMAIGVHAHLGGLNI

SEQ ID NO: 24250 - protein, 32 aa, Brucella spp.
MERKEIHNLRHAVRMLFDRTKPIRQRAQDVLA

SEQ ID NO: 24251 - protein, 17 aa, Brucella spp.
RGLKSFFDPHEIALMGL

SEQ ID NO: 24252 - protein, 21 aa, Brucella spp.
LKSFFDPHEIALMGLGAILKN

SEQ ID NO: 24253 - protein, 26 aa, Brucella spp.
ASAPSIPIVKYIAPSVWAWRPQRARA

SEQ ID NO: 24254 - protein, 35 aa, Brucella spp.
LSYKADWFARKFLMPKITIWSAALPNIIVDEPVVP

SEQ ID NO: 24255 - protein, 28 aa, Brucella spp.
EHGDFLETCYLLLYGELPTATQKADFDY

SEQ ID NO: 24256 - protein, 19 aa, Brucella spp.
SNFLHMCFTVPCEEYKVNP

SEQ ID NO: 24257 - protein, 33 aa, Brucella spp.
LTDEYFIEKKLYPNIDFYSGITLKALGFPTEMF

SEQ ID NO: 24258 - protein, 28 aa, Brucella spp.
LKALGFPTEMFTVLFALARTVGWVAQWK

SEQ ID NO: 24259 - protein, 26 aa, Brucella spp.
GGARTALFNWLYAKHCGGKMLLRIED

SEQ ID NO: 24260 - protein, 25 aa, Brucella spp.
NKDLDDFIILRSDGTPTYMHAVVVD

SEQ ID NO: 24261 - protein, 23 aa, Brucella spp.
AARQTIIYNAMGWDVPQMSHIPL

SEQ ID NO: 24262 - protein, 25 aa, Brucella spp.
DAYRAIGYLPAALRNYLVRLGWSHG

SEQ ID NO: 24263 - protein, 18 aa, Brucella spp.
MSTEQMIEWFDVKDINKG

SEQ ID NO: 24264 - protein, 19 aa, Brucella spp.
LADGAKFIFASRPLALDEK

SEQ ID NO: 24265 - protein, 17 aa, Brucella spp.
FIFASRPLALDEKAASL

SEQ ID NO: 24266 - protein, 24 aa, Brucella spp.
QRRIPEFLMPHIVNGQARRVPNLK

SEQ ID NO: 24267 - protein, 21 aa, Brucella spp.
LLLFIHERLKETGIPPSFDEM

SEQ ID NO: 24268 - protein, 19 aa, Brucella spp.
REGKRLIILHGLDKGRHIR

SEQ ID NO: 24269 - protein, 18 aa, Brucella spp.
LIILHGLDKGRHIRRAGL

SEQ ID NO: 24270 - protein, 18 aa, Brucella spp.
ARLPVFTRPRVAILATGD

SEQ ID NO: 24271 - protein, 26 aa, Brucella spp.
NCGVALDFWKIAMRPGKPLMYGRKAV

SEQ ID NO: 24272 - protein, 30 aa, Brucella spp.
NPVSSLVCSLLFLRPLVAKLSGLALKADIR

SEQ ID NO: 24273 - protein, 31 aa, Brucella spp.
AAKRTSDLIPLCHPLMLTKVAVEIEPDENLP

SEQ ID NO: 24274 - protein, 23 aa, Brucella spp.
SPSKGLIRPDFDPPALAKAYEEG

SEQ ID NO: 24275 - protein, 30 aa, Brucella spp.
ACSLPALRKDFLFDPYQVYEARSWGADCIL

SEQ ID NO: 24276 - protein, 24 aa, Brucella spp.
RSWGADCILIIMASVDDDLAKELE

SEQ ID NO: 24277 - protein, 25 aa, Brucella spp.
SEAGLGFMFAPMHHSAMRHVGPSRV

SEQ ID NO: 24278 - protein, 26 aa, Brucella spp.
VELGTRTIFNLLGPLSNPASVKRQLV

SEQ ID NO: 24279 - protein, 28 aa, Brucella spp.
VKRQLVGVFAPQWLEPLAHVLKELGSET

SEQ ID NO: 24280 - protein, 21 aa, Brucella spp.
DSAYRDIVLLNSGAALVVAGK

SEQ ID NO: 24281 - protein, 21 aa, Brucella spp.
HLLIVLALVGVVLIQRSEGGG

SEQ ID NO: 24282 - protein, 31 aa, Brucella spp.
ELPRGTAVYIHLTLMPYIPAAGELKTKPTQH

SEQ ID NO: 24283 - protein, 23 aa, Brucella spp.
RERKVPYFGICFGMQMACIEAAR

SEQ ID NO: 24284 - protein, 27 aa, Brucella spp.
ETVEYADHPWFIGVQYHPELKSRPFEP

SEQ ID NO: 24285 - protein, 25 aa, Brucella spp.
ELKSRPFEPHPLFASFIEAAIEQSR

SEQ ID NO: 24286 - protein, 29 aa, Brucella spp.
APVVDVLQIPAFLCRQTDLLIAAARTGRV

SEQ ID NO: 24287 - protein, 24 aa, Brucella spp.
NVKKGQFLAPWDMKNVLAKITESG

SEQ ID NO: 24288 - protein, 25 aa, Brucella spp.
VSDMRALPIMAGLGAPVIFDATHSV

SEQ ID NO: 24289 - protein, 26 aa, Brucella spp.
QASGLPLYRYVGGTNAHVLPVPMMNI

SEQ ID NO: 24290 - protein, 24 aa, Brucella spp.
TNAHVLPVPMMNIINGGAHADNPI

SEQ ID NO: 24291 - protein, 31 aa, Brucella spp.
AHADNPIDFQEFMILPVGATSIREAVRYGSE

SEQ ID NO: 24292 - protein, 23 aa, Brucella spp.
AYREMLLIRRFEEKAGQLYGMGF

SEQ ID NO: 24293 - protein, 28 aa, Brucella spp.
KAGQLYGMGFIGGFCHLYIGQEAVVVGM

SEQ ID NO: 24294 - protein, 32 aa, Brucella spp.
VYESFNMASLWKLPVIYVIENNRYAMGTAVSR

SEQ ID NO: 24295 - protein, 25 aa, Brucella spp.
RSGRGPIILEMLTYRYRGHSMSDPA

SEQ ID NO: 24296 - protein, 29 aa, Brucella spp.
FAGLKPIVEFMTFNFAMQAIDQIVNSAAK

SEQ ID NO: 24297 - protein, 24 aa, Brucella spp.
SQCYAAWYSHIPGLKVVMPYTAAD

SEQ ID NO: 24298 - protein, 26 aa, Brucella spp.
IRDPNPVIFLENEILYGHHFDVPKLD

SEQ ID NO: 24299 - protein, 21 aa, Brucella spp.
VPKLDDFVLPIGKARIHKQGK

SEQ ID NO: 24300 - protein, 18 aa, Brucella spp.
VMQQAFDYLDAPILTIAG

SEQ ID NO: 24301 - protein, 18 aa, Brucella spp.
FDYLDAPILTIAGKDVPM

SEQ ID NO: 24302 - protein, 31 aa, Brucella spp.
LVESKQTVPHFYLTIDCELDALLALRSQINA

SEQ ID NO: 24303 - protein, 20 aa, Brucella spp.
LSVNDMVIKATALALRDVPE

SEQ ID NO: 24304 - protein, 17 aa, Brucella spp.
VIKATALALRDVPEANV

SEQ ID NO: 24305 - protein, 34 aa, Brucella spp.
SVSNLGMFGVKDFAAIINPPHATIFAIGAGEERA

SEQ ID NO: 24306 - protein, 24 aa, Brucella spp.
HLGGICLNWGCIPTKALLRSAEIL

SEQ ID NO: 24307 - protein, 25 aa, Brucella spp.
NGGVAFLMKKNKIDVIWGEAKLVKA

SEQ ID NO: 24308 - protein, 30 aa, Brucella spp.
GIEPDGKLIWTYFEAMVPQALPKSMLVMGS

SEQ ID NO: 24309 - protein, 23 aa, Brucella spp.
AILGWFGVWTLTLALGLGGFAFG

SEQ ID NO: 24310 - protein, 20 aa, Brucella spp.
GFAFGLIWAPVFRALGLAAR

SEQ ID NO: 24311 - protein, 19 aa, Brucella spp.
IEILTPDFLRKEGALEIVV

SEQ ID NO: 24312 - protein, 28 aa, Brucella spp.
LKVRPGARYFHSIRLLQRVKELDPTIFT

SEQ ID NO: 24313 - protein, 24 aa, Brucella spp.
RSADVDFMTIGQYLQPTRKHHPVI

SEQ ID NO: 24314 - protein, 24 aa, Brucella spp.
IGKTKGFLLVASSPLTRSSHHAGE

SEQ ID NO: 24315 - protein, 23 aa, Brucella spp.
GPKQYRLIGAEAVLARTLRAFTD

SEQ ID NO: 24316 - protein, 26 aa, Brucella spp.
LARTLRAFTDCPLIGTIAVVIHPDDH

SEQ ID NO: 24317 - protein, 41 aa, Brucella spp.
LKDEAPQYVLIHDGVRPFIGQDLLERIIANLTPDNGVLPAL

SEQ ID NO: 24318 - protein, 17 aa, Brucella spp.
FAAQTPQAFPYAPILDA

SEQ ID NO: 24319 - protein, 19 aa, Brucella spp.
QAFPYAPILDAHEKAFAIN

SEQ ID NO: 24320 - protein, 24 aa, Brucella spp.
NGILDYIIRHYEDMLDHYGSKIGI

SEQ ID NO: 24321 - protein, 24 aa, Brucella spp.
ARKHLGWYMDRHAGRAFTPADKAE

SEQ ID NO: 24322 - protein, 23 aa, Brucella spp.
SNAASLWRWVAAGDGDLVISDVM

SEQ ID NO: 24323 - protein, 19 aa, Brucella spp.
FDLLPRIKKIRPDLPVVVM

SEQ ID NO: 24324 - protein, 19 aa, Brucella spp.
EIYRLLARMMQTDLTVMVT

SEQ ID NO: 24325 - protein, 30 aa, Brucella spp.
QGLFREDLYYRLNVVPLRLPPLRERSEDVP

SEQ ID NO: 24326 - protein, 24 aa, Brucella spp.
TNAGLEMMRRYPWPGNVRELENLV

SEQ ID NO: 24327 - protein, 37 aa, Brucella spp.
DRTVTLALVIINVALILFLILLICREVYRIITARRLG

SEQ ID NO: 24328 - protein, 24 aa, Brucella spp.
SRLHVRIVALFSLIAAIPAIVVAI

SEQ ID NO: 24329 - protein, 24 aa, Brucella spp.
REIPDMYLYTVRSVPPQILDAINL

SEQ ID NO: 24330 - protein, 38 aa, Brucella spp.
DANRIPTQIAFALLYFGLTLIVLLSAIWTGIAVADRLV

SEQ ID NO: 24331 - protein, 30 aa, Brucella spp.
AINDRAPRLVFLDIWLQGSRLDGLALLDEI

SEQ ID NO: 24332 - protein, 24 aa, Brucella spp.
TFREDLFHRLSVVPVQVPALAARR

SEQ ID NO: 24333 - protein, 24 aa, Brucella spp.
DIPSLVEFFMKQIAEQAGIKPRKI

SEQ ID NO: 24334 - protein, 28 aa, Brucella spp.
LKAEYQDLFLRENLPIDVIISPEIEVGE

SEQ ID NO: 24335 - protein, 17 aa, Brucella spp.
PIDVIISPEIEVGEVVL

SEQ ID NO: 24336 - protein, 22 aa, Brucella spp.
TPLRQLTELFPDLTATVVGVVR

SEQ ID NO: 24337 - protein, 31 aa, Brucella spp.
LTVVQFSDIFRIMLIKYQQGVWLDTDVYLLK

SEQ ID NO: 24338 - protein, 18 aa, Brucella spp.
PLYYRLIHKEVTPASIGI

SEQ ID NO: 24339 - protein, 23 aa, Brucella spp.
QPGSFYMWAIDRVRPLLESKENK

SEQ ID NO: 24340 - protein, 19 aa, Brucella spp.
VIDRTGLILEIFGERARTK

SEQ ID NO: 24341 - protein, 24 aa, Brucella spp.
NAGKSMLFNRMTGAQVLAEDMLFA

SEQ ID NO: 24342 - protein, 26 aa, Brucella spp.
QVLAEDMLFATLDPTLRRIRLPHGET

SEQ ID NO: 24343 - protein, 31 aa, Brucella spp.
LGSVDLVLSPFDLHLLDWIYQHGSDVQRENL

SEQ ID NO: 24344 - protein, 27 aa, Brucella spp.
GERAYDIFSRLLKERIIFVNGPVEDGM

SEQ ID NO: 24345 - protein, 22 aa, Brucella spp.
GMSMLVCAQLLFLEAENPKKEI

SEQ ID NO: 24346 - protein, 25 aa, Brucella spp.
MAIYDTMQFIRPPVSTLCMGQAASM

SEQ ID NO: 24347 - protein, 24 aa, Brucella spp.
AQTLARIIDVPFIMADATTLTEAG

SEQ ID NO: 24348 - protein, 24 aa, Brucella spp.
EDVENIILKLLQAADYNVERAQRG

SEQ ID NO: 24349 - protein, 26 aa, Brucella spp.
FLQVDTTNILFICGGAFAGLDRIISA

SEQ ID NO: 24350 - protein, 26 aa, Brucella spp.
PEDLLKFGLIPEFVGRLPVIATLEDL

SEQ ID NO: 24351 - protein, 30 aa, Brucella spp.
ARGLRSIMEKILLDTMFELPTLEGVREVVI

SEQ ID NO: 24352 - protein, 37 aa, Brucella spp.
ADGLYAVLPLRDIVVFPHMIVPLFVGREKSIRALEEV

SEQ ID NO: 24353 - protein, 18 aa, Brucella spp.
ANVLQLLKLPDGTVKVLV

SEQ ID NO: 24354 - protein, 31 aa, Brucella spp.; identical to SEQ ID NO: 16878

SEQ ID NO: 24355 - protein, 17 aa, Brucella spp.
FMDHYLEVEYDLSNVMF

SEQ ID NO: 24356 - protein, 18 aa, Brucella spp.
DLSNVMFVTTANTMNIPG

SEQ ID NO: 24357 - protein, 20 aa, Brucella spp.
GPLLDRMEIIRIAGYTEDEK

SEQ ID NO: 24358 - protein, 32 aa, Brucella spp.
TVGTVTEIYDYMRLLFARVGIPYSPATGLPIE

SEQ ID NO: 24359 - protein, 26 aa, Brucella spp.
ALEEGTRLYILAPIVRGRKGEYRKEL

SEQ ID NO: 24360 - protein, 27 aa, Brucella spp.
GFTIPEIEPRLFSFNNPFGACPTCDGL

SEQ ID NO: 24361 - protein, 26 aa, Brucella spp.
KEIRERLQFLNDVGLDYLTLARNSGT

SEQ ID NO: 24362 - protein, 25 aa, Brucella spp.
GGKSTFLIETLFKAASRRIMGSREH

SEQ ID NO: 24363 - protein, 25 aa, Brucella spp.
YTGAFTPIRDWFAGLPEAKARGYQP

SEQ ID NO: 24364 - protein, 27 aa, Brucella spp.
QGDGVIKIEMHFLPDVYVTCDVCHGKR

SEQ ID NO: 24365 - protein, 24 aa, Brucella spp.
ATGRTLYILDEPTTGLHFHDVAKL

SEQ ID NO: 24366 - protein, 22 aa, Brucella spp.
PTTGLHFHDVAKLLEVLHELVE

SEQ ID NO: 24367 - protein, 17 aa, Brucella spp.
ILVGNLGADPEIRRLNS

SEQ ID NO: 24368 - protein, 26 aa, Brucella spp.
RKDRTEWHSVVIFNENLAKVAEQYLK

SEQ ID NO: 24369 - protein, 25 aa, Brucella spp.
DRYSTEIVLQKFRGELQMLDSRSEG

SEQ ID NO: 24370 - protein, 26 aa, Brucella spp.
RVAGGLLLFWIAFEMIFEKRTERKEK

SEQ ID NO: 24371 - protein, 27 aa, Brucella spp.
ALLGVIFVCLLITYFVLLLAERVDRFL

SEQ ID NO: 24372 - protein, 25 aa, Brucella spp.
REQEPVVLPARFPNLLVNGSGGIAV

SEQ ID NO: 24373 - protein, 24 aa, Brucella spp.
AIELSELMELIPGPDFPTGGIILG

SEQ ID NO: 24374 - protein, 27 aa, Brucella spp.
VADVVLNQLYRYTPLQTSFGCNMVALN

SEQ ID NO: 24375 - protein, 28 aa, Brucella spp.
GGKPEQLTLLDMLRAFVAFREEVVTRRT

SEQ ID NO: 24376 - protein, 29 aa, Brucella spp.
AREQLMERRWPAVDVAPLIRLIDDPRHTL

SEQ ID NO: 24377 - protein, 17 aa, Brucella spp.
ILDLRLQRLTALGRDEV

SEQ ID NO: 24378 - protein, 50 aa, Brucella spp.
KEEDFVTRLFVANTHTPVLFFSSRGIVYKEKLWRLPVGTPQSRGKALINM

SEQ ID NO: 24379 - protein, 18 aa, Brucella spp.
LINMLPLQQGERITTIMP

SEQ ID NO: 24380 - protein, 18 aa, Brucella spp.
IGKLVALFPVEGSDQILL

SEQ ID NO: 24381 - protein, 17 aa, Brucella spp.
ALFPVEGSDQILLVSDG

SEQ ID NO: 24382 - protein, 25 aa, Brucella spp.
HPGKKPLFSFDERVALIEASAKAVL

SEQ ID NO: 24383 - protein, 24 aa, Brucella spp.
APELQTVFLPADPAVRTITATLVR

SEQ ID NO: 24384 - protein, 24 aa, Brucella spp.
WSGATDIFITPGYRFRAVDLLMTN

SEQ ID NO: 24385 - protein, 38 aa, Brucella spp.
RFRAVDLLMTNFHLPRSTLFMLVSAFSGLDTMHAAYNY

SEQ ID NO: 24386 - protein, 35 aa, Brucella spp.
IIFLVVVVGGLIGFNLFRSKMIKDFFANMQQPAQT

SEQ ID NO: 24387 - protein, 25 aa, Brucella spp.
TLQNIDIMRIDFTVPEQLLATIKLG

SEQ ID NO: 24388 - protein, 27 aa, Brucella spp.
EETTDPELFHLMGQAGLLGVTLPEDYG

SEQ ID NO: 24389 - protein, 27 aa, Brucella spp.
MMSVQSSLVMYPIYAYGSDEQRKKYLP

SEQ ID NO: 24390 - protein, 25 aa, Brucella spp.
RLSGSKMWISNSPIADVFVVWAKSA

SEQ ID NO: 24391 - protein, 20 aa, Brucella spp.
EDCWFRARQYGLDRKQFNKP

SEQ ID NO: 24392 - protein, 24 aa, Brucella spp.
EEGAAFMPRFDASGLITAIVTDAR

SEQ ID NO: 24393 - protein, 22 aa, Brucella spp.
EAAVRTLLLWAGEDPDREGLLE

SEQ ID NO: 24394 - protein, 27 aa, Brucella spp.
VAGYDDMVLVKDISFFSHCEHHMVPII

SEQ ID NO: 24395 - protein, 17 aa, Brucella spp.
SHCEHHMVPIIGKAHVA

SEQ ID NO: 24396 - protein, 20 aa, Brucella spp.
HHMVPIIGKAHVAYLPEGRV

SEQ ID NO: 24397 - protein, 25 aa, Brucella spp.
LFGTALIRFYQITLSSLIGNSCRHL

SEQ ID NO: 24398 - protein, 25 aa, Brucella spp.
AGQDLKIYYQGDWFDLCRGPHMAST

SEQ ID NO: 24399 - protein, 43 aa, Brucella spp.
GREMDLFHFQEEGPGVVFWHAKGWKMFQNLVSYMRRRLDSHGY

SEQ ID NO: 24400 - protein, 20 aa, Brucella spp.
TSGHWGWYRDNMFKVTVAGD

SEQ ID NO: 24401 - protein, 21 aa, Brucella spp.
AECLQINDLILSVYKDFGFEE

SEQ ID NO: 24402 - protein, 19 aa, Brucella spp.
DFNLPERFGAFYIGADSEK

SEQ ID NO: 24403 - protein, 37 aa, Brucella spp.
SMERFLGILIENFAGHMPLWFAPVQVVVATITSDADE

SEQ ID NO: 24404 - protein, 25 aa, Brucella spp.
KRLRDGVVWRAVAATLVASPAFAQG

SEQ ID NO: 24405 - protein, 26 aa, Brucella spp.
GDIPAGLVWRVFSPDVGPDGQLPLIA

SEQ ID NO: 24406 - protein, 24 aa, Brucella spp.
NSARHEIMILDAGGMKLSAVLPGN

SEQ ID NO: 24407 - protein, 17 aa, Brucella spp.
DVKPNKIIRLNSGTYHV

SEQ ID NO: 24408 - protein, 17 aa, Brucella spp.
IIRLNSGTYHVVSNYGT

SEQ ID NO: 24409 - protein, 19 aa, Brucella spp.
REELGDLLLQVVFHARMAE

SEQ ID NO: 24410 - protein, 17 aa, Brucella spp.
LLLQVVFHARMAEEQGY

SEQ ID NO: 24411 - protein, 21 aa, Brucella spp.
VDDIPNAFPALLRALKLQQKA

SEQ ID NO: 24412 - protein, 26 aa, Brucella spp.
EEEYGDLLFAMVNLGRHLEIDAETAL

SEQ ID NO: 24413 - protein, 23 aa, Brucella spp.
EKFKRRFHFIEEALKTSGRDLDA

SEQ ID NO: 24414 - protein, 24 aa, Brucella spp.
VLASTFVLFPILGLAAGWAIPGLS

SEQ ID NO: 24415 - protein, 25 aa, Brucella spp.
ASNIFGMFLTPLLVGLLFAIKGGGG

SEQ ID NO: 24416 - protein, 25 aa, Brucella spp.
MMVGVNILLLAVVLLATWYGSKWLG

SEQ ID NO: 24417 - protein, 28 aa, Brucella spp.
ANVGNIVLPLMLFHQIQLMACAIIARKL

SEQ ID NO: 24418 - protein, 23 aa, Brucella spp.
ATDPFQITLITGASLGHDVDKLL

SEQ ID NO: 24419 - protein, 31 aa, Brucella spp.
PIPIMACDSRIGLPYIPIAPEKIAGIVITQE

SEQ ID NO: 24420 - protein, 23 aa, Brucella spp.
IAGHLIEFFKGEVVKGRLDLALN

SEQ ID NO: 24421 - protein, 17 aa, Brucella spp.
PFHNLRMYSEVLQDSTF

SEQ ID NO: 24422 - protein, 25 aa, Brucella spp.
ISNHPEVIRRLGIIGINTALEFDIY

SEQ ID NO: 24423 - protein, 23 aa, Brucella spp.
GGHTPHLLEEAFSWHLRRQENGS

SEQ ID NO: 24424 - protein, 18 aa, Brucella spp.
VHYYRYLYEQVGRQHHWM

SEQ ID NO: 24425 - protein, 25 aa, Brucella spp.
AKPDTVEILYFGLIADFQGRGLARF

SEQ ID NO: 24426 - protein, 20 aa, Brucella spp.
LARFFLNEAISAAWAHSPQK

SEQ ID NO: 24427 - protein, 23 aa, Brucella spp.
SPRALQLYQKMGFVPVAWSEEEV

SEQ ID NO: 24428 - protein, 30 aa, Brucella spp.
PGMFSAPRVWWMFRVMGVKNVYVLDGGFDG

SEQ ID NO: 24429 - protein, 38 aa, Brucella spp.
DVGEKLVLHIDWQRRYKLMRMHTACHLLSVACPFPITG

SEQ ID NO: 24430 - protein, 18 aa, Brucella spp.
CHLLSVACPFPITGAAVG

SEQ ID NO: 24431 - protein, 20 aa, Brucella spp.
RAALYIIRDAEKRGLLRPGG

SEQ ID NO: 24432 - protein, 25 aa, Brucella spp.
SQEKKEVLRLLGAELIEVPAAPYRN

SEQ ID NO: 24433 - protein, 23 aa, Brucella spp.
PDFSYQIPDAEALDILFALVEEE

SEQ ID NO: 24434 - protein, 30 aa, Brucella spp.
NRYQSKLFNPAFLRGKSLPVPRWLEKKTEI

SEQ ID NO: 24435 - protein, 24 aa, Brucella spp.
RKYGAQIWLKREDLTPVRSYKLRG

SEQ ID NO: 24436 - protein, 19 aa, Brucella spp.
FGRKGVVFMPVTTPQQKID

SEQ ID NO: 24437 - protein, 36 aa, Brucella spp.
DVRERALRFEGLKKYFIFRFPQCPGALRSFLDLLGP

SEQ ID NO: 24438 - protein, 30 aa, Brucella spp.
LISTQWQMQHHGMIIVPLSYAYREQMGNDV

SEQ ID NO: 24439 - protein, 23 aa, Brucella spp.
PDGSIVFRLENINVPAQFSQVAA

SEQ ID NO: 24440 - protein, 23 aa, Brucella spp.
NDVPSWLWRSVADEDALSKLPEG

SEQ ID NO: 24441 - protein, 28 aa, Brucella spp.
VFDRLAGTWTYWGWKGGYFDSEEDAVAF

SEQ ID NO: 24442 - protein, 25 aa, Brucella spp.
VAPNSPQWFNTGLSWAYGIDGPGQG

SEQ ID NO: 24443 - protein, 26 aa, Brucella spp.
VNEGGIMDLWVREARLFKYGSGTGSN

SEQ ID NO: 24444 - protein, 18 aa, Brucella spp.
TLKARDLWEKIGYAAWAS

SEQ ID NO: 24445 - protein, 29 aa, Brucella spp.
AYEHTARLWTIVLEISVMMAQFPSREIAR

SEQ ID NO: 24446 - protein, 26 aa, Brucella spp.
AALKSAFDIKFAFNKWTLGEDFCKDV

SEQ ID NO: 24447 - protein, 28 aa, Brucella spp.
TDEQLNDFSFELLPVLGFSKKDIEAANI

SEQ ID NO: 24448 - protein, 26 aa, Brucella spp.
YLSVESHIHMMAAAQPFISGAISKTI

SEQ ID NO: 24449 - protein, 27 aa, Brucella spp.
EDCKNAYMLSWKLALKANALYRDGSKL

SEQ ID NO: 24450 - protein, 23 aa, Brucella spp.
AAFRAMMNNFAIAVSLGLQYGVP

SEQ ID NO: 24451 - protein, 27 aa, Brucella spp.
KTATSIIDYVFRELAVSYLGRNDLAHV

SEQ ID NO: 24452 - protein, 30 aa, Brucella spp.
GILALLVLGLVIWLAVKPPELLRLGTAYAA

SEQ ID NO: 24453 - protein, 25 aa, Brucella spp.
KTVTTYFLGFFAPSSATYHRPGLGC

SEQ ID NO: 24454 - protein, 23 aa, Brucella spp.
TDVTRMLFLEQDMAGFAASMPLV

SEQ ID NO: 24455 - protein, 23 aa, Brucella spp.
KEALDFPMHALFDPLGLSNAVLE

SEQ ID NO: 24456 - protein, 25 aa, Brucella spp.
GIPKDAFWMFGHDGQSVMIVPSRKL

SEQ ID NO: 24457 - protein, 19 aa, Brucella spp.
FRAKLVAWKNDILREARET

SEQ ID NO: 24458 - protein, 30 aa, Brucella spp.
VDIVDYPGEWLLDLPLLGKTYAQFSADSFA

SEQ ID NO: 24459 - protein, 24 aa, Brucella spp.
TYVVKPFFREHIARLDRQIVLIDA

SEQ ID NO: 24460 - protein, 25 aa, Brucella spp.
QDEPAIRFVRFRPPRLERTAEGVTL

SEQ ID NO: 24461 - protein, 30 aa, Brucella spp.
ERKGWSLSRILFGALGILVSFAIGIWTEDL

SEQ ID NO: 24462 - protein, 19 aa, Brucella spp.
ILVSFAIGIWTEDLIRALF

SEQ ID NO: 24463 - protein, 24 aa, Brucella spp.
EDLIRALFARADWLGWTALGVAMV

SEQ ID NO: 24464 - protein, 23 aa, Brucella spp.
AAFAAIILRELVALRRLASVQHL

SEQ ID NO: 24465 - protein, 23 aa, Brucella spp.
PGTLGFIKFARRVIAHLAVTGTI

SEQ ID NO: 24466 - protein, 20 aa, Brucella spp.
LTLLPVSLSVSPVMAADKDK

SEQ ID NO: 24467 - protein, 24 aa, Brucella spp.
ADKDKQFFQTIEGQWSGPGEIVAG

SEQ ID NO: 24468 - protein, 17 aa, Brucella spp.
RVEKELVPVIGMSLKRV

SEQ ID NO: 24469 - protein, 26 aa, Brucella spp.
RLERWGPRIIDIDILVMQDETGRAIT

SEQ ID NO: 24470 - protein, 25 aa, Brucella spp.
PRMHERAFVLAPLNDIAPSLPVGAR

SEQ ID NO: 24471 - protein, 33 aa, Brucella spp.
LEQALDIDFGDDIYIDMDLGAFDEGFSIDDLEE

SEQ ID NO: 24472 - protein, 28 aa, Brucella spp.
RITEHSSKLYWTTTAISVAWAAGGVAIS

SEQ ID NO: 24473 - protein, 47 aa, Brucella spp.
SSLQATKDFFTAPAGLGVVAGVALPIAMFWGFAQLVKRAQEMQNAAR

SEQ ID NO: 24474 - protein, 25 aa, Brucella spp.
EGVEKLMQSFEALVASAFQRAEGQT

SEQ ID NO: 24475 - protein, 30 aa, Brucella spp.
YRRGERNVFTRRLYTLKGQQTFDDIKRKYQ

SEQ ID NO: 24476 - protein, 27 aa, Brucella spp.
EFRRAVDRYMNDFQRLLEDVARNDRDN

SEQ ID NO: 24477 - protein, 35 aa, Brucella spp.
LVGVFTLLVSLLAFGFVYWIARYGEARDSLPLDVR

SEQ ID NO: 24478 - protein, 26 aa, Brucella spp.
DFDEAALFFHRYPKPGKLEIQATKPL

SEQ ID NO: 24479 - protein, 24 aa, Brucella spp.
QMAEKPLIMALANPKPEIMPEEAR

SEQ ID NO: 24480 - protein, 29 aa, Brucella spp.
PNQVNNVLCFPYIFRGALDVGATVINEEM

SEQ ID NO: 24481 - protein, 34 aa, Brucella spp.
PTFGPDYIIPSPFDQRLILRIAPAVAKAAMETGV

SEQ ID NO: 24482 - protein, 28 aa, Brucella spp.
AYLDRLNRFVFRSGLIMKPVFAAARTQG

SEQ ID NO: 24483 - protein, 18 aa, Brucella spp.
PRYRDYVDLYLSYTGRQG

SEQ ID NO: 24484 - protein, 25 aa, Brucella spp.
KGEANLLVFPNLDAANITLNVVKAV

SEQ ID NO: 24485 - protein, 19 aa, Brucella spp.
TMLRIAVAQLNPTMGDIAG

SEQ ID NO: 24486 - protein, 32 aa, Brucella spp.
AEAARMQADLILFTELFISGYPPEDMVLKPAF

SEQ ID NO: 24487 - protein, 25 aa, Brucella spp.
LETVQRIEHLLYLAEYKRRQSTPGV

SEQ ID NO: 24488 - protein, 24 aa, Brucella spp.
VQQELLLFLISLPVAGFLAPTWLA

SEQ ID NO: 24489 - protein, 25 aa, Brucella spp.
FLAPTWLAFLLMTGSILFLVLVEVL

SEQ ID NO: 24490 - protein, 20 aa, Brucella spp.
RLIAPFSALVLMAGVHSAFT

SEQ ID NO: 24491 - protein, 30 aa, Brucella spp.
KVVETLGRFPLPIEVNRFGLGATIRAIEAA

SEQ ID NO: 24492 - protein, 25 aa, Brucella spp.
GVVEHGLFIELARAAIIAGTDGIRT

SEQ ID NO: 24493 - protein, 20 aa, Brucella spp.
IIVFDLDGTLVDTAPDLLDS

SEQ ID NO: 24494 - protein, 18 aa, Brucella spp.
ISHYNEFTLEMAGDLIAA

SEQ ID NO: 24495 - protein, 20 aa, Brucella spp.
VKPQKPIVTAPPPAPEPDQA

SEQ ID NO: 24496 - protein, 25 aa, Brucella spp.
VADIAQHMFPQKQPVAVLCGPGNNG

SEQ ID NO: 24497 - protein, 23 aa, Brucella spp.
YVAAQYLLEAGYEAVCFAAAPPR

SEQ ID NO: 24498 - protein, 25 aa, Brucella spp.
RAKATVTFFRKKPGHLLQPGRAHCG

SEQ ID NO: 24499 - protein, 26 aa, Brucella spp.
GRAHCGIIHIADIGIPDRILGEINPR

SEQ ID NO: 24500 - protein, 27 aa, Brucella spp.
PETAHIDPFFAQSTLVILCDILEPLSG

SEQ ID NO: 24501 - protein, 24 aa, Brucella spp.
GPEAEFFVFDDVKFKADPFNTGFK

SEQ ID NO: 24502 - protein, 23 aa, Brucella spp.
GLSENCLYFIGGVIKHAKAVNAF

SEQ ID NO: 24503 - protein, 17 aa, Brucella spp.
LVPGYEAPVLLAYSARN

SEQ ID NO: 24504 - protein, 25 aa, Brucella spp.
PKSKRLEFRFPDPSANPYLCFSALL

SEQ ID NO: 24505 - protein, 26 aa, Brucella spp.
DPSANPYLCFSALLMAGLDGIKNKIH

SEQ ID NO: 24506 - protein, 23 aa, Brucella spp.
LKMAEVMRFEMTPHPVEFDMYYS

SEQ ID NO: 24507 - protein, 22 aa, Brucella spp.
IALVIFIMFGWGLNQVAIKIGN

SEQ ID NO: 24508 - protein, 34 aa, Brucella spp.
AFLFQAIFVVAFTYPLWFWMVRRYPASKLSNFAF

SEQ ID NO: 24509 - protein, 28 aa, Brucella spp.
EAGMRLDRWFKIHYPGLGFGHLQKLLRA

SEQ ID NO: 24510 - protein, 34 aa, Brucella spp.
DGDVLSQMLLYEDPKIFVFNKPAGLAVQGGSGVT

SEQ ID NO: 24511 - protein, 23 aa, Brucella spp.
APLPPHMVQSWNLLGFDEENAEE

SEQ ID NO: 24512 - protein, 27 aa, Brucella spp.
KGDIFSPLLMWAALGGFNIMAAVFVAR

SEQ ID NO: 24513 - protein, 31 aa, Brucella spp.
IRATDSLFTLWLEFMRQHLTTVVALATLIPV

SEQ ID NO: 24514 - protein, 34 aa, Brucella spp.
IPVAMTMDMRMSLVLIVLGVIYVMIGQLVMRKTK

SEQ ID NO: 24515 - protein, 25 aa, Brucella spp.
ENAQFPVLNWWALASGLNRMASTFS

SEQ ID NO: 24516 - protein, 18 aa, Brucella spp.
MRVGDVIAFIGFAQLMIG

SEQ ID NO: 24517 - protein, 25 aa, Brucella spp.
IDTGPDFRMQMIDSGVHMLDAAVYT

SEQ ID NO: 24518 - protein, 27 aa, Brucella spp.
QYIKDADVLIIGALQYRPHPSHFSLGE

SEQ ID NO: 24519 - protein, 23 aa, Brucella spp.
SPKRAILTHMHVPLDYETVMRET

SEQ ID NO: 24520 - protein, 27 aa, Brucella spp.
ETEKGAFPFILHCFSSGRALAEKGIEL

SEQ ID NO: 24521 - protein, 18 aa, Brucella spp.
YKASQVIWQAMVANGDIY

SEQ ID NO: 24522 - protein, 17 aa, Brucella spp.
VIWQAMVANGDIYKGGY

SEQ ID NO: 24523 - protein, 25 aa, Brucella spp.
WVEEESYFFRLSAYQDKLLDLYENN

SEQ ID NO: 24524 - protein, 26 aa, Brucella spp.
PGDEKHVMYVWVDALTNYITALGYPD

SEQ ID NO: 24525 - protein, 35 aa, Brucella spp.
IGKDISRFHAVYWPAFLMSAQLPLPKRVFAHGFLF

SEQ ID NO: 24526 - protein, 26 aa, Brucella spp.
RYGLDQLRYFLMREVPFGQDGSYSHE

SEQ ID NO: 24527 - protein, 25 aa, Brucella spp.
APDFSKPLWRQIAGGMHPAVLHITR

SEQ ID NO: 24528 - protein, 28 aa, Brucella spp.
LEEPPARALFILISHSSGRLLPTIRSRC

SEQ ID NO: 24529 - protein, 23 aa, Brucella spp.
AEVQYELFRDYLMGRIAAEARRY

SEQ ID NO: 24530 - protein, 23 aa, Brucella spp.
KRGSAAMLALMAVAVTLAGCAST

SEQ ID NO: 24531 - protein, 25 aa, Brucella spp.
PYQVKGRWYYPKEDKNYTAVGRASW

SEQ ID NO: 24532 - protein, 25 aa, Brucella spp.
DRGPYEYDRVIDLSWKAAEMLDYQH

SEQ ID NO: 24533 - protein, 25 aa, Brucella spp.
PSGQAPVMPAHVPVPTIRPGSSFGV

SEQ ID NO: 24534 - protein, 26 aa, Brucella spp.
EDEGEYIELGLFPSLAAAKKLESALP

SEQ ID NO: 24535 - protein, 26 aa, Brucella spp.
NELCDARLAWLKGLGTFSTFGKGWTS

SEQ ID NO: 24536 - protein, 26 aa, Brucella spp.
EWLSLRSYWGIFLGAAAIAVVTILLA

SEQ ID NO: 24537 - protein, 23 aa, Brucella spp.
PIAIAFTALIGLLFARRLIRRVI

SEQ ID NO: 24538 - protein, 26 aa, Brucella spp.
AQKDIKVWYVPAMFWPEVANIKSKIV

SEQ ID NO: 24539 - protein, 23 aa, Brucella spp.
MAAPDIVFFDYPGNFRGIREHNS

SEQ ID NO: 24540 - protein, 33 aa, Brucella spp.
MPEYLKGFRFDDVPFFFYSSQLRPHKNIEGLIR

SEQ ID NO: 24541 - protein, 24 aa, Brucella spp.
CADSDLWLVVSYSVEYPIAPIRPT

SEQ ID NO: 24542 - protein, 36 aa, Brucella spp.
EYPIAPIRPTLIFATDFIQRYVPDIIWPPRPGEGDA

SEQ ID NO: 24543 - protein, 25 aa, Brucella spp.
SKVKEPYFLWPTNPNAHKNHAKAFQ

SEQ ID NO: 24544 - protein, 24 aa, Brucella spp.
ELLASACFLWHPTLADNGTFAAVE

SEQ ID NO: 24545 - protein, 23 aa, Brucella spp.
QPVPAGYLMPGMALLCIDTGTEL

SEQ ID NO: 24546 - protein, 23 aa, Brucella spp.
GAIGRFLLRANHINIGDFIEDGS

SEQ ID NO: 24547 - protein, 30 aa, Brucella spp.
KGAAATPYVWDILIRNVYAFGCRGRGIRMR

SEQ ID NO: 24548 - protein, 19 aa, Brucella spp.
MRDGFAFLRFEDVEIGLGP

SEQ ID NO: 24549 - protein, 17 aa, Brucella spp.
FLRFEDVEIGLGPQYGG

SEQ ID NO: 24550 - protein, 25 aa, Brucella spp.
VSLPAYEFRNFEGLFLRRTEATGLD

SEQ ID NO: 24551 - protein, 25 aa, Brucella spp.
IRLDQDVVQRFKATGKGWQGRMNDA

SEQ ID NO: 24552 - protein, 32 aa, Brucella spp.
LYAAVQFMLENDQFLPHMLGDIRLACNALYRH

SEQ ID NO: 24553 - protein, 19 aa, Brucella spp.
RLACNALYRHFFTHNRKKV

SEQ ID NO: 24554 - protein, 25 aa, Brucella spp.
DMHDTGLFSWTYLHKLGVEKDTLWQ

SEQ ID NO: 24555 - protein, 27 aa, Brucella spp.
TYCMAEHMTFLPKKDLLTLEELDRLCS

SEQ ID NO: 24556 - protein, 26 aa, Brucella spp.
EPLVRKNIMHLIGNLSRHLKSGALDE

SEQ ID NO: 24557 - protein, 17 aa, Brucella spp.
PEKFRTITRWGDLSRVL

SEQ ID NO: 24558 - protein, 25 aa, Brucella spp.
ETGGRLGFITPMTYNFCESCNRVRL

SEQ ID NO: 24559 - protein, 35 aa, Brucella spp.
PDLEKWLQYAEKASIFWFAKHIGFEVVNIPLAHAP

SEQ ID NO: 24560 - protein, 24 aa, Brucella spp.
AESYDPFFNINLPDDLLKAREINE

SEQ ID NO: 24561 - protein, 25 aa, Brucella spp.
NDESLPVFDINAIDEIADFIEQEMA

SEQ ID NO: 24562 - protein, 27 aa, Brucella spp.
REIKGHLWHFRYPLENVPFDPENPHTY

SEQ ID NO: 24563 - protein, 23 aa, Brucella spp.
NWEKTYFDWMENIQPWCVSRQLW

SEQ ID NO: 24564 - protein, 26 aa, Brucella spp.
PWCVSRQLWWGHQIPAWYGPDSHCFV

SEQ ID NO: 24565 - protein, 40 aa, Brucella spp.
YYPTSVLVTGFDILFFWVARMMMMGLHFMEEIPFHTVYLH

SEQ ID NO: 24566 - protein, 33 aa, Brucella spp.
AGAAYRFVWNQFCDWYLEFLKPIFMGDDEAAKA

SEQ ID NO: 24567 - protein, 30 aa, Brucella spp.
CLDQVYKLLHPFMPFMTEELWSLTASEGKK

SEQ ID NO: 24568 - protein, 28 aa, Brucella spp.
TGTVGIQLNQMLFDGFQTRNNVAAAETQ

SEQ ID NO: 24569 - protein, 35 aa, Brucella spp.
NDEQNTLYQAVAAYMDVYQLRQIAALREKNLAAMN

SEQ ID NO: 24570 - protein, 32 aa, Brucella spp.
EKDGAKVFIAPEAVLFLLGTQMDFEVTTLRTG

SEQ ID NO: 24571 - protein, 27 aa, Brucella spp.
TGKTASFVLPMLTLLEKGRARARMPRT

SEQ ID NO: 24572 - protein, 24 aa, Brucella spp.
VKYGINHRLNVALLIGGVSFEEQE

SEQ ID NO: 24573 - protein, 46 aa, Brucella spp.
EADRMLDMGFIPDIERICKLIPFTRQTLFFSATMPPEITKLTEQFL

SEQ ID NO: 24574 - protein, 24 aa, Brucella spp.
RGSVGFLMNEFVIENLPERILAAQ

SEQ ID NO: 24575 - protein, 28 aa, Brucella spp.
LSAQGPILPLEAPLLALTPVSPFRPRRW

SEQ ID NO: 24576 - protein, 19 aa, Brucella spp.
LTPVSPFRPRRWGGALLPK

SEQ ID NO: 24577 - protein, 35 aa, Brucella spp.
EILLSIMEHHSNIVPWHFIRERQGAKLVFTPVDDN

SEQ ID NO: 24578 - protein, 26 aa, Brucella spp.
VQDLGCDWYVFTGHKVYGPSGIGVLY

SEQ ID NO: 24579 - protein, 23 aa, Brucella spp.
RRIESWHYTDFRTLLKGVAAFDT

SEQ ID NO: 24580 - protein, 29 aa, Brucella spp.
TVGDGAQIIWVILRDFGQATQLSQFNVTI

SEQ ID NO: 24581 - protein, 24 aa, Brucella spp.
GKGSRLTLYIVNAGGKLVRQEVHV

SEQ ID NO: 24582 - protein, 29 aa, Brucella spp.
TVAELSRDYLFYLMARGIPENEARGLLIK

SEQ ID NO: 24583 - protein, 21 aa, Brucella spp.
EARGLLIKAFIAEIIEELEDE

SEQ ID NO: 24584 - protein, 29 aa, Brucella spp.
ERAAKGIFLAFQYPMEIPGVATMEFLKVA

SEQ ID NO: 24585 - protein, 18 aa, Brucella spp.
KRAEILQMQLLEPSLCVL

SEQ ID NO: 24586 - protein, 22 aa, Brucella spp.
DRAVIVITHYQRLLEHIVPDSV

SEQ ID NO: 24587 - protein, 18 aa, Brucella spp.
YLDYNASAPLLDEARDAI

SEQ ID NO: 24588 - protein, 25 aa, Brucella spp.
TLLTPNYMMGRSPVRLSHLYVSATE

SEQ ID NO: 24589 - protein, 28 aa, Brucella spp.
PVDANGILRLDILRGLLAAHDRSKGLPL

SEQ ID NO: 24590 - protein, 30 aa, Brucella spp.
TMNNKIVYDLFYMFQQRGFTTLRFNFRGIG

SEQ ID NO: 24591 - protein, 25 aa, Brucella spp.
LRQLEHDLTLLHAVAVHDFLHEQGL

SEQ ID NO: 24592 - protein, 25 aa, Brucella spp.
GQGAPLIPAYHAALAANLPLGLKGP

SEQ ID NO: 24593 - protein, 25 aa, Brucella spp.
LGLKGPVVFVNIGGISNLTYVGEDG

SEQ ID NO: 24594 - protein, 24 aa, Brucella spp.
SGPGNMLIDQWMELHGHGRFDPGG

SEQ ID NO: 24595 - protein, 24 aa, Brucella spp.
EAWAYLAVRSLCGLPLTYPSTTGC

SEQ ID NO: 24596 - protein, 34 aa, Brucella spp.
VSRCSHALLSICILLVLLGGVGFVILRGGVNSDL

SEQ ID NO: 24597 - protein, 25 aa, Brucella spp.
GIKSVRLGLAPLPLLTGKLRVAQLE

SEQ ID NO: 24598 - protein, 29 aa, Brucella spp.
FGDGSPEMIFMLRIPKMPVADAKHLWPID

SEQ ID NO: 24599 - protein, 22 aa, Brucella spp.
GAREWVLKNLFGGTLQDSRIDI

SEQ ID NO: 24600 - protein, 23 aa, Brucella spp.
SNGTLVIPWGPQRPVMADLDLHV

SEQ ID NO: 24601 - protein, 30 aa, Brucella spp.
SADLLKTQIDLPWLGWRKGAGIPAKATFDL

SEQ ID NO: 24602 - protein, 28 aa, Brucella spp.
SNDAGAVLRFFDFYDKMRGGKITVGLAA

SEQ ID NO: 24603 - protein, 26 aa, Brucella spp.
MPAYGVNRIFGEVPIFGALLGNGRDR

SEQ ID NO: 24604 - protein, 25 aa, Brucella spp.
AKQPQVIVNPISLIAPGIFRSIFEF

SEQ ID NO: 24605 - protein, 25 aa, Brucella spp.
SLKGHPVVVYFYPKDDTSGCTREAI

SEQ ID NO: 24606 - protein, 24 aa, Brucella spp.
GVERTTFLIGADGRIAQVWNKVKV

SEQ ID NO: 24607 - protein, 26 aa, Brucella spp.
ESQDWASMLLRMYTRWAERNGRKVEV

SEQ ID NO: 24608 - protein, 26 aa, Brucella spp.
RHTSFASIWVYPVIDDNIEVQVTEAD

SEQ ID NO: 24609 - protein, 29 aa, Brucella spp.
IGWGHQIRSYVLQPYQLVKDLRTGVESTN

SEQ ID NO: 24610 - protein, 24 aa, Brucella spp.
SEIHPDYYQIPVADRLALLEAEAK

SEQ ID NO: 24611 - protein, 25 aa, Brucella spp.
QYNIQEVIKRRQILLVQVVKEERGN

SEQ ID NO: 24612 - protein, 29 aa, Brucella spp.
EVKRDYEYLMRLWENVRTLTLQSTAPALV

SEQ ID NO: 24613 - protein, 27 aa, Brucella spp.
YREAKDFMRMLMPSHAKVVQPYRDHIP

SEQ ID NO: 24614 - protein, 17 aa, Brucella spp.
QPYRDHIPIFTRNGVEA

SEQ ID NO: 24615 - protein, 24 aa, Brucella spp.
EAQLDRMLVPQVTLKSGGYLIINQ

SEQ ID NO: 24616 - protein, 24 aa, Brucella spp.
KSGGYLIINQTEALVAIDVNSGRS

SEQ ID NO: 24617 - protein, 27 aa, Brucella spp.
EEVARQLRLRDLAGLIVVDFIDMEEKR

SEQ ID NO: 24618 - protein, 27 aa, Brucella spp.
SDSSMALHIIRGIEDYLLRHSGFDIHV

SEQ ID NO: 24619 - protein, 24 aa, Brucella spp.
RRIPDPEFVGYTPVLPVKAEESIG

SEQ ID NO: 24620 - protein, 29 aa, Brucella spp.
PAKTLSFLNLIRRFVAASGAIAIAVTGAF

SEQ ID NO: 24621 - protein, 25 aa, Brucella spp.
GKRGVRVILVNSPSFNAFVDGRRIF

SEQ ID NO: 24622 - protein, 26 aa, Brucella spp.
DPHKSPLLRMSYGRALMLTGTKANMP

SEQ ID NO: 24623 - protein, 27 aa, Brucella spp.
KAVENIVRNYLLQNPELMLEVQTALET

SEQ ID NO: 24624 - protein, 28 aa, Brucella spp.
KKDPNVRYVLKEFPILGPDSMRAHVVSQ

SEQ ID NO: 24625 - protein, 23 aa, Brucella spp.
MPEKYPEFHEMLLGGHGRATEES

SEQ ID NO: 24626 - protein, 20 aa, Brucella spp.
GEKNAYVLINPAAYSHTSVA

SEQ ID NO: 24627 - protein, 18 aa, Brucella spp.
YVLINPAAYSHTSVAIHD

SEQ ID NO: 24628 - protein, 34 aa, Brucella spp.
RGAGTIEFLYEDGEFYFIEMNTRLQVEHPVTEAI

SEQ ID NO: 24629 - protein, 18 aa, Brucella spp.
FAPSPGLITHYHTPGGLG

SEQ ID NO: 24630 - protein, 25 aa, Brucella spp.
YSGYRIPPYYDSLTGKLIVHGRNRV

SEQ ID NO: 24631 - protein, 25 aa, Brucella spp.
GVKTTLPLFQDLISNQDIANGDYDI

SEQ ID NO: 24632 - protein, 30 aa, Brucella spp.
ITLDRKIRRIFTGWMFADSPGLNAVEHPIY

SEQ ID NO: 24633 - protein, 19 aa, Brucella spp.
VEHPIYDVWLKDCKQKSDV

SEQ ID NO: 24634 - protein, 19 aa, Brucella spp.
FTWWNGQTLGTRFHTWRKG

SEQ ID NO: 24635 - protein, 23 aa, Brucella spp.
GRTRRWVIFNGYSEASTIPPGWH

SEQ ID NO: 24636 - protein, 28 aa, Brucella spp.
KSVFDRKNYFYPDLPQGYQISQFKQPIV

SEQ ID NO: 24637 - protein, 17 aa, Brucella spp.
YLTKLRTIVRYLGTCDG

SEQ ID NO: 24638 - protein, 33 aa, Brucella spp.
KEEAHDYRYFPDPDLLPLEFDQAFVDALAAKLP

SEQ ID NO: 24639 - protein, 24 aa, Brucella spp.
KAAANWVINDLLGALNKAGKDIEE

SEQ ID NO: 24640 - protein, 21 aa, Brucella spp.
AKDLFEIVWNEGGDPKKLVEE

SEQ ID NO: 24641 - protein, 28 aa, Brucella spp.
VLDGKADFVFSLNYEVLPAIEVKDFSKI

SEQ ID NO: 24642 - protein, 24 aa, Brucella spp.
LVLGSGQFIPGFEEQLIGLKAGDE

SEQ ID NO: 24643 - protein, 27 aa, Brucella spp.
LVDAEFNNIWQQINFDLQQAGRTFEDE

SEQ ID NO: 24644 - protein, 23 aa, Brucella spp.
EKEIYDFLRRTPDAVANLRAPIF

SEQ ID NO: 24645 - protein, 44 aa, Brucella spp.
ETDADALAFFDAIAPIIHFDSINMDVCWFQSRYDKVGPGGTGKD

SEQ ID NO: 24646 - protein, 23 aa, Brucella spp.
ALGTLYNMVGFQTKLKYGSQTGI

SEQ ID NO: 24647 - protein, 23 aa, Brucella spp.
SQTGIFKMIPGLENAEFARLGGL

SEQ ID NO: 24648 - protein, 28 aa, Brucella spp.
PGKRSFQPMNVNFGLFPPVDVPKPEGKR

SEQ ID NO: 24649 - protein, 22 aa, Brucella spp.
ASDIEILLVGTGMDLRRIPEDV

SEQ ID NO: 24650 - protein, 27 aa, Brucella spp.
LMSILPFILIFVIMYFLIIRPQRTQMK

SEQ ID NO: 24651 - protein, 17 aa, Brucella spp.
FVWAPERLVLDPVSRVN

SEQ ID NO: 24652 - protein, 36 aa, Brucella spp.
IDSLPVLMNLIKETRHRFILFCDDLSFDHDDTSYKS

SEQ ID NO: 24653 - protein, 31 aa, Brucella spp.
DERRDGRGFPYFWLHFGRGKAPVADDSDIAA

SEQ ID NO: 24654 - protein, 18 aa, Brucella spp.
ERTAFLPFLIASPILFLI

SEQ ID NO: 24655 - protein, 17 aa, Brucella spp.
AFLPFLIASPILFLIGG

SEQ ID NO: 24656 - protein, 30 aa, Brucella spp.
FLIGGALVYFFFTPMVMWFFLAMQQTGGSG

SEQ ID NO: 24657 - protein, 27 aa, Brucella spp.
FVKVGSGWAFRTAPDLAFIMNRETVQQ

SEQ ID NO: 24658 - protein, 24 aa, Brucella spp.
KLSRATMEVLAIIAYHQPVTRAEL

SEQ ID NO: 24659 - protein, 23 aa, Brucella spp.
GTTDAFLDHFGLPEIRDLPGLEE

SEQ ID NO: 24660 - protein, 28 aa, Brucella spp.
ELAADYLVMAAWLAYLKSKLLIPKQQGD

SEQ ID NO: 24661 - protein, 25 aa, Brucella spp.
DWVSLDRFLIDYALSPQERASALAS

SEQ ID NO: 24662 - protein, 25 aa, Brucella spp.
VHEDDPLMELSRIMDFDTPADDNVA

SEQ ID NO: 24663 - protein, 27 aa, Brucella spp.
TGEAPAYPYYPRSNFAPGVAAPGVLSS

SEQ ID NO: 24664 - protein, 26 aa, Brucella spp.
KTPQAPIVQDFVAQDPFRPIEDEFSL

SEQ ID NO: 24665 - protein, 24 aa, Brucella spp.
TADEDFFNDEDFFTDVELDLHEEE

SEQ ID NO: 24666 - protein, 22 aa, Brucella spp.
DRAFEDIFRESASTYMPNSGMA

SEQ ID NO: 24667 - protein, 24 aa, Brucella spp.
ASQDDFYNHWAAQGAQTMEGGDYG

SEQ ID NO: 24668 - protein, 42 aa, Brucella spp.
RPVRGRRGLILASVAGVAVLLGGIGYHFLGGGGSGEPVVIRA

SEQ ID NO: 24669 - protein, 25 aa, Brucella spp.
PREVETMIVRPDGTIIQPSFGHAAQ

SEQ ID NO: 24670 - protein, 23 aa, Brucella spp.
TPETPRLPTRAPIVPSRPAEQPV

SEQ ID NO: 24671 - protein, 25 aa, Brucella spp.
AAGAGGYFIQIASQPSAELAQKSYA

SEQ ID NO: 24672 - protein, 27 aa, Brucella spp.
FINLRLKASYWQRELLVMLNEGTDFGR

SEQ ID NO: 24673 - protein, 26 aa, Brucella spp.
DGKAKLTVLLCQLVKLFRNGEPVRMS

SEQ ID NO: 24674 - protein, 28 aa, Brucella spp.
VGRDPVRFMMLYRKNDAPLDFDFAKVTE

SEQ ID NO: 24675 - protein, 28 aa, Brucella spp.
IHQEPHRLAFYLYDLASSFHSQWNRGAE

SEQ ID NO: 24676 - protein, 26 aa, Brucella spp.
VIEKLGARVLIDSISVPYMDGSEIDF

SEQ ID NO: 24677 - protein, 28 aa, Brucella spp.
SEKSRSPFELFKFGFSAYKNGHKDEAIK

SEQ ID NO: 24678 - protein, 23 aa, Brucella spp.
AQAMLGNMLFQAGKTVRGLAMLT

SEQ ID NO: 24679 - protein, 24 aa, Brucella spp.
LCRDTPLFPPPLPHEPNPVCIISD

SEQ ID NO: 24680 - protein, 27 aa, Brucella spp.
FAAMPQLEFILVVGQYALAYHLPDYRG

SEQ ID NO: 24681 - protein, 22 aa, Brucella spp.
LKRNPWFDMEVVPVLQAKVRHL

SEQ ID NO: 24682 - protein, 17 aa, Brucella spp.
DDFRELIRNLPGPDLGA

SEQ ID NO: 24683 - protein, 25 aa, Brucella spp.
LGRLEEIVAWLATWTGKRTPQVNRP

SEQ ID NO: 24684 - protein, 17 aa, Brucella spp.
AINQICIANDLGLKVFD

SEQ ID NO: 24685 - protein, 19 aa, Brucella spp.
ICIANDLGLKVFDLALEHP

SEQ ID NO: 24686 - protein, 18 aa, Brucella spp.
MEKIPVIVDGFVASAAAA

SEQ ID NO: 24687 - protein, 17 aa, Brucella spp.
IRSLGFLSRLPLPQGWF

SEQ ID NO: 24688 - protein, 17 aa, Brucella spp.
GFLSRLPLPQGWFDNTD

SEQ ID NO: 24689 - protein, 24 aa, Brucella spp.
FAALTLVIWTGVKASLLMAIIARA

SEQ ID NO: 24690 - protein, 24 aa, Brucella spp.
ASRAGMLAFWHALPSARPGGLADS

SEQ ID NO: 24691 - protein, 28 aa, Brucella spp.
MVALINALVLMTVVLFGFARLCMAKIGG

SEQ ID NO: 24692 - protein, 18 aa, Brucella spp.
RAAYLGIWGIVLAAGLLG

SEQ ID NO: 24693 - protein, 22 aa, Brucella spp.
RNIAIWSVIILGLVAGYQYRYD

SEQ ID NO: 24694 - protein, 37 aa, Brucella spp.
AEEPLKLVIGTEGAYPPFNFINPDGSLSGFDVDIARA

SEQ ID NO: 24695 - protein, 21 aa, Brucella spp.
AECTFITQEWDGTIPALQAGK

SEQ ID NO: 24696 - protein, 24 aa, Brucella spp.
KSFDAFLFDMDGTILSSIAATERV

SEQ ID NO: 24697 - protein, 24 aa, Brucella spp.
WARRHGIDPVTFLPTIHGVRAVET

SEQ ID NO: 24698 - protein, 25 aa, Brucella spp.
PIEGAYKFLHSLPENRWAIVTSAPL

SEQ ID NO: 24699 - protein, 21 aa, Brucella spp.
NARIVLTDDVILGSVKLTDGL

SEQ ID NO: 24700 - protein, 25 aa, Brucella spp.
HYAPRPRVRWNPIAAVQAHDAQIAA

SEQ ID NO: 24701 - protein, 30 aa, Brucella spp.
SDYIPASMMQSAFFLAEVVENISLPQAIRL

SEQ ID NO: 24702 - protein, 23 aa, Brucella spp.
NISLPQAIRLVSANPARALRLDD

SEQ ID NO: 24703 - protein, 22 aa, Brucella spp.
DLLAALMHFASSAAPVVIPRLE

SEQ ID NO: 24704 - protein, 31 aa, Brucella spp.
RQRHNLVRWGYPYVFEEFRFHMTLTGPVEEK

SEQ ID NO: 24705 - protein, 37 aa, Brucella spp.
AGFCLEPQIWPGALEYPYFPQPILRPGDIYAQISHFT

SEQ ID NO: 24706 - protein, 29 aa, Brucella spp.
EKLSTELRPTLFLAQLSNLLAGNISIVHK

SEQ ID NO: 24707 - protein, 24 aa, Brucella spp.
NAEHFDMILGAELGGLLKHDGWAA

SEQ ID NO: 24708 - protein, 27 aa, Brucella spp.
TGHLREAQFPLALALGAISVWKGEAFA

SEQ ID NO: 24709 - protein, 18 aa, Brucella spp.
LFRWSRKLKQFNYWLWAQ

SEQ ID NO: 24710 - protein, 37 aa, Brucella spp.
WSRKLKQFNYWLWAQAVFVLLGFLRLFPAKAAISFSA

SEQ ID NO: 24711 - protein, 22 aa, Brucella spp.
VMDGHFVPNITFGPQVVKAIRP

SEQ ID NO: 24712 - protein, 29 aa, Brucella spp.
RPRTKAFFDAHLMIAPCDPYLEPFAEAGC

SEQ ID NO: 24713 - protein, 27 aa, Brucella spp.
TNVLDDLDLILVMTVNPGFGGQKFIAP

SEQ ID NO: 24714 - protein, 32 aa, Brucella spp.
EMVAIWSPETKFRIWFEIEAYACEALAELGVI

SEQ ID NO: 24715 - protein, 23 aa, Brucella spp.
VTKHDVIAFLTHLAEFIGPDSRF

SEQ ID NO: 24716 - protein, 27 aa, Brucella spp.
VIPRDRHAMFFATLGVIASSMENIAIE

SEQ ID NO: 24717 - protein, 23 aa, Brucella spp.
VIEKLVIYPDNMLKNMNKFRGLV

SEQ ID NO: 24718 - protein, 17 aa, Brucella spp.
KFRGLVHSQRVLLALTQ

SEQ ID NO: 24719 - protein, 27 aa, Brucella spp.
EKIRPKHLMTFGPYPRERLPFPTIMVV

SEQ ID NO: 24720 - protein, 25 aa, Brucella spp.
PYPRERLPFPTIMVVSRNDPFSSFE

SEQ ID NO: 24721 - protein, 17 aa, Brucella spp.
LPRSIIEFYYKADALDD

SEQ ID NO: 24722 - protein, 29 aa, Brucella spp.
LAIRVNDFLTGLFLGIGIQLVDFKMECGR

SEQ ID NO: 24723 - protein, 27 aa, Brucella spp.
SIPDDVDLILIPGGFSYGDYLRCGAIA

SEQ ID NO: 24724 - protein, 18 aa, Brucella spp.
ADKGVMVMGVCNGFQILL

SEQ ID NO: 24725 - protein, 31 aa, Brucella spp.
GVMVMGVCNGFQILLEAGLLPGALMRNASLK

SEQ ID NO: 24726 - protein, 26 aa, Brucella spp.
KPDEYQRILELIGREPTFTELGIFSA

SEQ ID NO: 24727 - protein, 20 aa, Brucella spp.
EPTFTELGIFSAMWNEHCSY

SEQ ID NO: 24728 - protein, 25 aa, Brucella spp.
YKSSKKWLRTLPTSGPRVIQGPGEN

SEQ ID NO: 24729 - protein, 27 aa, Brucella spp.
KEAEAQAIFRKWGLDFAIVGKTTDDLR

SEQ ID NO: 24730 - protein, 24 aa, Brucella spp.
DLSSRRWVYEQYDTLIQGNSLQVP

SEQ ID NO: 24731 - protein, 17 aa, Brucella spp.
VMMVFMILPVVAPATGQ

SEQ ID NO: 24732 - protein, 36 aa, Brucella spp.
PATGQLIMLFGEWHLIFMFMAIMALVVGLWAFLRLP

SEQ ID NO: 24733 - protein, 27 aa, Brucella spp.
RRISQTMLLVFTSFSLLWMVLSIVMDG

SEQ ID NO: 24734 - protein, 26 aa, Brucella spp.
PIPFAVLMIIYMTIMLSFSLVTANFN

SEQ ID NO: 24735 - protein, 31 aa, Brucella spp.
GKDSYGLLALLLDLKWRGLLPVELLAVNLDQ

SEQ ID NO: 24736 - protein, 27 aa, Brucella spp.
REDILETFFMNLFHGGRLAAMPPKLLN

SEQ ID NO: 24737 - protein, 18 aa, Brucella spp.
SAIFAFGFTAAAQADAVP

SEQ ID NO: 24738 - protein, 30 aa, Brucella spp.
RRNDVGFVYQFHHLLPEFSALENVMLPQMI

SEQ ID NO: 24739 - protein, 23 aa, Brucella spp.
YDSSIVMMPLSEAQLFFNQEGKV

SEQ ID NO: 24740 - protein, 29 aa, Brucella spp.
LEVERNVMFMILTLIVLVAALNIISGLIM

SEQ ID NO: 24741 - protein, 23 aa, Brucella spp.
VERLREFFSWLSGTTLFNPELYF

SEQ ID NO: 24742 - protein, 24 aa, Brucella spp.
SVIVMALVLSFIATIFPAWRAAKL

SEQ ID NO: 24743 - protein, 19 aa, Brucella spp.
FVFLPLGGVGEIGMNLAMY

SEQ ID NO: 24744 - protein, 18 aa, Brucella spp.
ADLILPDIRYLEAEKHNL

SEQ ID NO: 24745 - protein, 35 aa, Brucella spp.
AHEDHFGALLDLWPRLKVPVYATPFIAGLLEAKRQ

SEQ ID NO: 24746 - protein, 29 aa, Brucella spp.
RRSELRRMYSWVRPQILVPVHGEAAHLVA

SEQ ID NO: 24747 - protein, 24 aa, Brucella spp.
AKLTGILLESSILAKNLFAVAIGI

SEQ ID NO: 24748 - protein, 19 aa, Brucella spp.
ILAKNLFAVAIGIGTNVVA

SEQ ID NO: 24749 - protein, 26 aa, Brucella spp.
FDKFEFPVLIVIATLGMLLMVSANSM

SEQ ID NO: 24750 - protein, 24 aa, Brucella spp.
ELGLVFGLIFILAGLVFKISAVPF

SEQ ID NO: 24751 - protein, 19 aa, Brucella spp.
THDWQQVIIFVALASMVLG

SEQ ID NO: 24752 - protein, 22 aa, Brucella spp.
KGVMIYMAIYLAMTLGSFAFIL

SEQ ID NO: 24753 - protein, 25 aa, Brucella spp.
VLATVMTIFLFSLAGIPPLAGFFGK

SEQ ID NO: 24754 - protein, 28 aa, Brucella spp.
ASVVGAFYYLRMIKIMWFDEPAAGFVPV

SEQ ID NO: 24755 - protein, 17 aa, Brucella spp.
MWFDEPAAGFVPVAGEL

SEQ ID NO: 24756 - protein, 23 aa, Brucella spp.
VTGAFVLFYVFLAGPIGGYAEAA

SEQ ID NO: 24757 - protein, 18 aa, Brucella spp.
YMIAFLILETLMIGVFCA

SEQ ID NO: 24758 - protein, 29 aa, Brucella spp.
VFCALDLFLFYVFFEASLIPMFIIIGVWG

SEQ ID NO: 24759 - protein, 26 aa, Brucella spp.
VYASLKFFLYTLLGSVLMLIAIMAMY

SEQ ID NO: 24760 - protein, 23 aa, Brucella spp.
SMQTWLWLAFFASFAVKMPMWPV

SEQ ID NO: 24761 - protein, 17 aa, Brucella spp.
FIRFSLPMFPLASADFA

SEQ ID NO: 24762 - protein, 26 aa, Brucella spp.
SPREKLILYPLVALTIFFGVYPTPVF

SEQ ID NO: 24763 - protein, 25 aa, Brucella spp.
ITSGLMVFVAILSWIVFFKIPLGHD

SEQ ID NO: 24764 - protein, 26 aa, Brucella spp.
DPHRPRFFAYLSLFTFAMLMLVTSDN

SEQ ID NO: 24765 - protein, 20 aa, Brucella spp.
VFHLFTHAFFKALLFLCAGS

SEQ ID NO: 24766 - protein, 21 aa, Brucella spp.
LIPVTYWMMIIGTVAITGLGI

SEQ ID NO: 24767 - protein, 26 aa, Brucella spp.
FTSFYSWRLIFMTFFGKPRASAEVMH

SEQ ID NO: 24768 - protein, 23 aa, Brucella spp.
VIGFVVAWIFYIRAPEMPKALAA

SEQ ID NO: 24769 - protein, 30 aa, Brucella spp.
HRGLYQFLLNKWYFDELYDFLFVRPARWLG

SEQ ID NO: 24770 - protein, 26 aa, Brucella spp.
FLNRKNVIVILMSIELILLSVNLNFV

SEQ ID NO: 24771 - protein, 22 aa, Brucella spp.
FFYLFAFIMIASAFMVIAARNP

SEQ ID NO: 24772 - protein, 25 aa, Brucella spp.
VHSVLFLILTFFNAAALFLLTGAEF

SEQ ID NO: 24773 - protein, 24 aa, Brucella spp.
ILYTHYVFYFQVAGLVLLVAMIGA

SEQ ID NO: 24774 - protein, 20 aa, Brucella spp.
KSLLLKEFASAFALSMRQFF

SEQ ID NO: 24775 - protein, 27 aa, Brucella spp.
ASAFALSMRQFFAPKATLNYPHEKGPV

SEQ ID NO: 24776 - protein, 20 aa, Brucella spp.
LLVVLLIVVAYLLYADRKIW

SEQ ID NO: 24777 - protein, 26 aa, Brucella spp.
FLDWNWLCLFPMFVVFFISALAETNR

SEQ ID NO: 24778 - protein, 37 aa, Brucella spp.
LPPVDVWFLSWVPGIIWFMLKLCFCFFLFAMVKAFVP

SEQ ID NO: 24779 - protein, 23 aa, Brucella spp.
AEVPRFCFHERLSIAGNCRMCLV

SEQ ID NO: 24780 - protein, 28 aa, Brucella spp.
KKAREGVMEFLLINHPLDCPICDQGGEC

SEQ ID NO: 24781 - protein, 27 aa, Brucella spp.
EWISDKTRFIWDGLRTQRLDRPYVRKD

SEQ ID NO: 24782 - protein, 28 aa, Brucella spp.
ARDMLGNLDVVFLLGADELDMMAKSSSF

SEQ ID NO: 24783 - protein, 27 aa, Brucella spp.
RAKLYADYPHMLAIDTITPRSADDLVA

SEQ ID NO: 24784 - protein, 23 aa, Brucella spp.
VSPVKDFYLTNPIARASAVMAEC

SEQ ID NO: 24785 - protein, 17 aa, Brucella spp.
FTNIYGFKDQSLKGAMA

SEQ ID NO: 24786 - protein, 18 aa, Brucella spp.
IYIRGEFMREREALQAAI

SEQ ID NO: 24787 - protein, 23 aa, Brucella spp.
QPRLKPPFPANMGLYGCPTTVNN

SEQ ID NO: 24788 - protein, 26 aa, Brucella spp.
CREGTGWMWRVMERMVKGNAQKREID

SEQ ID NO: 24789 - protein, 32 aa, Brucella spp.
EYVAAMLNMPLIRVLEVATFYTQFQLKPVGSR

SEQ ID NO: 24790 - protein, 25 aa, Brucella spp.
CANAPMVMIFKDAYEDLTPERLAEI

SEQ ID NO: 24791 - protein, 25 aa, Brucella spp.
PKRGQLIRVLYSEIGRILNHLLNVT

SEQ ID NO: 24792 - protein, 19 aa, Brucella spp.
ALTPPLWGFEEREKLMVFY

SEQ ID NO: 24793 - protein, 19 aa, Brucella spp.
REKLMVFYERACGARMHAA

SEQ ID NO: 24794 - protein, 17 aa, Brucella spp.
MVFYERACGARMHAAYF

SEQ ID NO: 24795 - protein, 27 aa, Brucella spp.
IEDIGKWIDPFFTTLKNLDDLITPNRI

SEQ ID NO: 24796 - protein, 25 aa, Brucella spp.
RSMEALIHHFKLYTEGYHVPAGEVY

SEQ ID NO: 24797 - protein, 24 aa, Brucella spp.
YGELTLCVPVASLIGVLTFLRDDV

SEQ ID NO: 24798 - protein, 20 aa, Brucella spp.
RQEFRNFDFLSPWEGTDYVL

SEQ ID NO: 24799 - protein, 33 aa, Brucella spp.
TSADALITWARTGSLMWMTFGLACCAVEMMHIS

SEQ ID NO: 24800 - protein, 26 aa, Brucella spp.
PPTAEALLYGILLLQKKIRRTGTIER

SEQ ID NO: 24801 - protein, 34 aa, Brucella spp.
ARMKFDIRFYLVSILFIIFDLEVAFLFPWAVSFG

SEQ ID NO: 24802 - protein, 18 aa, Brucella spp.
FMKREFPQLGEAFEIVTV

SEQ ID NO: 24803 - protein, 17 aa, Brucella spp.
TTNLNINFLRKPSPGTV

SEQ ID NO: 24804 - protein, 19 aa, Brucella spp.
NLNINFLRKPSPGTVEAVA

SEQ ID NO: 24805 - protein, 25 aa, Brucella spp.
AEVVKKWVLIDAEGLVVGRLASLVA

SEQ ID NO: 24806 - protein, 18 aa, Brucella spp.
YTDKKYYWHTGHPGGIKE

SEQ ID NO: 24807 - protein, 18 aa, Brucella spp.
YYWHTGHPGGIKERTARQ

SEQ ID NO: 24808 - protein, 32 aa, Brucella spp.
DKEFEKYFARPVLQMILQQPIVASNRAGQFDI

SEQ ID NO: 24809 - protein, 27 aa, Brucella spp.
PDYLAANNFLYGLPLKHKHVPELQLHG

SEQ ID NO: 24810 - protein, 17 aa, Brucella spp.
DRRPIFSPSVGRFPQGM

SEQ ID NO: 24811 - protein, 32 aa, Brucella spp.
IFSPSVGRFPQGMIVQVPLFLSELEGSPSLAK

SEQ ID NO: 24812 - protein, 25 aa, Brucella spp.
ADRGKRVIFIDMTAFGTVSAAMLDG

SEQ ID NO: 24813 - protein, 27 aa, Brucella spp.
RSADRLPLILDALETIYDFVLIECGPS

SEQ ID NO: 24814 - protein, 25 aa, Brucella spp.
NTNLNFYYPLIIIAGSALFVMLMEL

SEQ ID NO: 24815 - protein, 25 aa, Brucella spp.
QFSRGWFIIWAVSAFGVLVISRLFI

SEQ ID NO: 24816 - protein, 26 aa, Brucella spp.
SVAKRIFDIVFSLLGIILLSPIMLAT

SEQ ID NO: 24817 - protein, 27 aa, Brucella spp.
GEEVPILPRRVMTFKASNVLKQRILQE

SEQ ID NO: 24818 - protein, 28 aa, Brucella spp.
DLQAVCSGFIYAITTADLYIRGGMARRV

SEQ ID NO: 24819 - protein, 25 aa, Brucella spp.
LTAEDIDWFVPHQANKRIIDASAKK

SEQ ID NO: 24820 - protein, 25 aa, Brucella spp.
IKKGDLVLLEAMGGGFTWGAVLVRW

SEQ ID NO: 24821 - protein, 28 aa, Brucella spp.
TPLGRYEMLSLHIFLALHRMKGENPALN

SEQ ID NO: 24822 - protein, 24 aa, Brucella spp.
IRPDLEFWPHACYLGAYVLQCRDC

SEQ ID NO: 24823 - protein, 24 aa, Brucella spp.
ATFDNEVFYYISQKRYRAAQFMKP

SEQ ID NO: 24824 - protein, 25 aa, Brucella spp.
QFMKPKVIERQILAIYFNKDGKVEH

SEQ ID NO: 24825 - protein, 25 aa, Brucella spp.
YLDADPQWFRAIVAGVVEDQLKLDP

SEQ ID NO: 24826 - protein, 25 aa, Brucella spp.
DQLKLDPMIHQALTEDWPLSRLDST

SEQ ID NO: 24827 - protein, 21 aa, Brucella spp.
ATLNDLRFMEATIRYARRHKG

SEQ ID NO: 24828 - protein, 22 aa, Brucella spp.
ARKRPEVILKLALSADGMIGRK

SEQ ID NO: 24829 - protein, 20 aa, Brucella spp.
ILRAQADIILIGIETALADD

SEQ ID NO: 24830 - protein, 30 aa, Brucella spp.
SFLDEKLVDRLIIFRSPLVIGAADGVAVEG

SEQ ID NO: 24831 - protein, 18 aa, Brucella spp.
TFERVQLRDLMVVKKSGR

SEQ ID NO: 24832 - protein, 27 aa, Brucella spp.
LKGIDDIAYIRFASVYRNFSKAVDFHN

SEQ ID NO: 24833 - protein, 17 aa, Brucella spp.
YLRKRLMISGDLPQEAG

SEQ ID NO: 24834 - protein, 25 aa, Brucella spp.
TMQEQRFVMVNIPAARIEAVEGGSV

SEQ ID NO: 24835 - protein, 25 aa, Brucella spp.
SKIHEVILNPYWTAPKSIIQKDIIP

SEQ ID NO: 24836 - protein, 18 aa, Brucella spp.
SSTKINFHNPYAVYMHDT

SEQ ID NO: 24837 - protein, 19 aa, Brucella spp.
INFHNPYAVYMHDTPQKSY

SEQ ID NO: 24838 - protein, 25 aa, Brucella spp.
QNVRDLDVWLLKNTPGWDRQNIEAT

SEQ ID NO: 24839 - protein, 32 aa, Brucella spp.
GVNTPIQLADPVPLHFVYISAWSTGDGVVQFR

SEQ ID NO: 24840 - protein, 18 aa, Brucella spp.
NAYLGFYGLIMSPGPVFK

SEQ ID NO: 24841 - protein, 19 aa, Brucella spp.
GFYGLIMSPGPVFKPGAPR

SEQ ID NO: 24842 - protein, 29 aa, Brucella spp.
ENHLTVNDLILSFFLTYGSGVTEPVEAMP

SEQ ID NO: 24843 - protein, 37 aa, Brucella spp.
IAEGADMLMVKPGLPYLDIIHRLKDEFRLPTFAYQVS

SEQ ID NO: 24844 - protein, 24 aa, Brucella spp.
ADGLSMVYSFFSPHMQERSLGTYM

SEQ ID NO: 24845 - protein, 17 aa, Brucella spp.
YMILDHIERARAAGLPH

SEQ ID NO: 24846 - protein, 24 aa, Brucella spp.
AAGLPHVYLGYWVEGSRKMQYKIR

SEQ ID NO: 24847 - protein, 28 aa, Brucella spp.
GLKPVHRRIMHAMRLLRLNPDQAYAKCA

SEQ ID NO: 24848 - protein, 23 aa, Brucella spp.
GNRGTWVIVVTEIPYQVQKSRLI

SEQ ID NO: 24849 - protein, 24 aa, Brucella spp.
LIEKIAELLLAKKLPLLDDIRDES

SEQ ID NO: 24850 - protein, 19 aa, Brucella spp.
ELLMESLFKLTELESRVSL

SEQ ID NO: 24851 - protein, 32 aa, Brucella spp.
AEIEKRLEILGGFLIAYLNLDEVIRIIREEDE

SEQ ID NO: 24852 - protein, 27 aa, Brucella spp.
HAETTDKLLFFTTGGKFFTIGANTLPG

SEQ ID NO: 24853 - protein, 26 aa, Brucella spp.
VGENRKMLVFPLSDIPEMTRGKGVRL

SEQ ID NO: 24854 - protein, 20 aa, Brucella spp.
RFVNREFSWLQFNRRVLEEA

SEQ ID NO: 24855 - protein, 19 aa, Brucella spp.
PLLERLRFLSISAANLDEF

SEQ ID NO: 24856 - protein, 25 aa, Brucella spp.
ANLDEFFMVRIAGLAGQVRAGIALR

SEQ ID NO: 24857 - protein, 32 aa, Brucella spp.
KHEKEWLENHFLETIFPVLTPLSIDPAHPFPF

SEQ ID NO: 24858 - protein, 29 aa, Brucella spp.
LSIDPAHPFPFIPNLGFSIALQLARRADN

SEQ ID NO: 24859 - protein, 26 aa, Brucella spp.
DNHPMTALLRIPVALKRFIQLPTDQN

SEQ ID NO: 24860 - protein, 26 aa, Brucella spp.
DQNNIYRFITIEDAVSLFIGRLFPGY

SEQ ID NO: 24861 - protein, 23 aa, Brucella spp.
DAVSLFIGRLFPGYEVRGAGTFR

SEQ ID NO: 24862 - protein, 17 aa, Brucella spp.
RDVAHIFNFITGYAQPA

SEQ ID NO: 24863 - protein, 17 aa, Brucella spp.
PAAIWMKMNSLVDPQII

SEQ ID NO: 24864 - protein, 17 aa, Brucella spp.
AIWMKMNSLVDPQIIDA

SEQ ID NO: 24865 - protein, 17 aa, Brucella spp.
WMKMNSLVDPQIIDALY

SEQ ID NO: 24866 - protein, 37 aa, Brucella spp.
VRREVGMVFQHFNLFPHLTILENCTLAPIWVRKMPKK

SEQ ID NO: 24867 - protein, 35 aa, Brucella spp.
VYVEVFRNIPPLLVIFFWYFGVLSVLPPVRQSYSM

SEQ ID NO: 24868 - protein, 20 aa, Brucella spp.
AQIKPEFLALFLALSFYTAS

SEQ ID NO: 24869 - protein, 17 aa, Brucella spp.
EFLALFLALSFYTASFI

SEQ ID NO: 24870 - protein, 24 aa, Brucella spp.
VEVVAIWMVIYLGISLIVSGLMNW

SEQ ID NO: 24871 - protein, 17 aa, Brucella spp.
MADYFRANKMEYNPVVF

SEQ ID NO: 24872 - protein, 26 aa, Brucella spp.
ANPDDHVILPEIISKEPFGLTVRQGD

SEQ ID NO: 24873 - protein, 23 aa, Brucella spp.
ARWADVVRWTHNALLNAEEYGIT

SEQ ID NO: 24874 - protein, 23 aa, Brucella spp.
GLDKDWVVKIIKGVGNYGEIFER

SEQ ID NO: 24875 - protein, 24 aa, Brucella spp.
AAITVPLLGFLSPGDHALLVDSIY

SEQ ID NO: 24876 - protein, 19 aa, Brucella spp.
LVDSIYYPTRHFANTILKR

SEQ ID NO: 24877 - protein, 35 aa, Brucella spp.
HKGNAIVMMDNTWATPLYFRALDFGVDISIHAATK

SEQ ID NO: 24878 - protein, 24 aa, Brucella spp.
PDDTYQILRRLRTMGIRLEHHRKS

SEQ ID NO: 24879 - protein, 25 aa, Brucella spp.
SLEDAFYQYLFDQQNRGELVFGAYP

SEQ ID NO: 24880 - protein, 17 aa, Brucella spp.
HLYVIFECKNHDASISE

SEQ ID NO: 24881 - protein, 30 aa, Brucella spp.
ANAFSAELILPDVTFLPQTAQFRHDLEIRD

SEQ ID NO: 24882 - protein, 20 aa, Brucella spp.
IFVDDQPCNYLPYEELLSRL

SEQ ID NO: 24883 - protein, 21 aa, Brucella spp.
QPCNYLPYEELLSRLSTYFEV

SEQ ID NO: 24884 - protein, 30 aa, Brucella spp.
SGSSTPILALGAILALGAFSLWSTAQHKSP

SEQ ID NO: 24885 - protein, 27 aa, Brucella spp.
SYGKTGRWHRVVVPSTNIIGWVHEDQL

SEQ ID NO: 24886 - protein, 24 aa, Brucella spp.
LKPDIICLAGYMRLLSGRFIAPYE

SEQ ID NO: 24887 - protein, 31 aa, Brucella spp.
APYEGRILNIHPSLLPLFPGLHTHQRALDAG

SEQ ID NO: 24888 - protein, 22 aa, Brucella spp.
DVVKHVILTRIVEYLKRKEQAF

SEQ ID NO: 24889 - protein, 24 aa, Brucella spp.
VEQPVLELLKPYLDAVYAVNTGVR

SEQ ID NO: 24890 - protein, 26 aa, Brucella spp.
YTLESEMQILLPCLTRLLEEEKGSNF

SEQ ID NO: 24891 - protein, 25 aa, Brucella spp.
DGQYRPVWYMVEEGQGFAALGRNVE

SEQ ID NO: 24892 - protein, 19 aa, Brucella spp.
CVDGFDRWYVYDGRCRVLR

SEQ ID NO: 24893 - protein, 18 aa, Brucella spp.
LIKRLRPRFNVLMRDDKS

SEQ ID NO: 24894 - protein, 35 aa, Brucella spp.
RLRPRFNVLMRDDKSFPYILLTGGHRAPGIFKHRG

SEQ ID NO: 24895 - protein, 28 aa, Brucella spp.
EGGMTCIQVFFFRTGQNWGNRAYFPKAD

SEQ ID NO: 24896 - protein, 20 aa, Brucella spp.
AFPAWPDVILIDGGQGQVGA

SEQ ID NO: 24897 - protein, 43 aa, Brucella spp.
EAGRERFFMEGKQPFTLPPRDPVLYFIQRLRDEAHRFAIGTHR

SEQ ID NO: 24898 - protein, 24 aa, Brucella spp.
IGIGLLWISAILTLYTGWDYFRAG

SEQ ID NO: 24899 - protein, 34 aa, Brucella spp.
MAKQALERWPLNGLTIIHRYGLIKPGENIVLVVA

SEQ ID NO: 24900 - protein, 25 aa, Brucella spp.
FEAASFLMDYMKTNAPFWKREHLAD

SEQ ID NO: 24901 - protein, 25 aa, Brucella spp.
TISGKVLYRERIALPPEASLIVQLV

SEQ ID NO: 24902 - protein, 25 aa, Brucella spp.
ISAGDTLWFVNDERYVIDPENPAAP

SEQ ID NO: 24903 - protein, 17 aa, Brucella spp.
NQERKFLDVLGKTRSYK

SEQ ID NO: 24904 - protein, 23 aa, Brucella spp.
VASKRVWMSRREAEGFYAVHKDR

SEQ ID NO: 24905 - protein, 28 aa, Brucella spp.
FYAVHKDRPFFGELVEFMSSGPTVVQVL

SEQ ID NO: 24906 - protein, 24 aa, Brucella spp.
PSAIPLVMPFALIIAITQTLSTMN

SEQ ID NO: 24907 - protein, 30 aa, Brucella spp.
KAELHRRFTQWIYPLIFAMIALAIAGDSRS

SEQ ID NO: 24908 - protein, 35 aa, Brucella spp.
ADKDPSYILVMYLVPLVVFLVTGFILLTGRRLGLP

SEQ ID NO: 24909 - protein, 31 aa, Brucella spp.
YFFTRYVQITLYFLLGIFALALLLDFTENAN

SEQ ID NO: 24910 - protein, 26 aa, Brucella spp.
SAMRVPFIMQQMIPFVALFSAMATLI

SEQ ID NO: 24911 - protein, 20 aa, Brucella spp.
VSAWQFLLPACFGALLFGLA

SEQ ID NO: 24912 - protein, 17 aa, Brucella spp.
FLLPACFGALLFGLATI

SEQ ID NO: 24913 - protein, 17 aa, Brucella spp.
CVLALPFVSVAILSSPA

SEQ ID NO: 24914 - protein, 25 aa, Brucella spp.
KNPDKPVLWQIKARKIIWNSATKTV

SEQ ID NO: 24915 - protein, 29 aa, Brucella spp.
VRFERGRFELFGMPLAYLPAFEMADPTVK

SEQ ID NO: 24916 - protein, 19 aa, Brucella spp.
KRKSGFLFPGFAYKDDLGF

SEQ ID NO: 24917 - protein, 26 aa, Brucella spp.
GFGIKNSYFWALAPNYDLTLSTTAYT

SEQ ID NO: 24918 - protein, 24 aa, Brucella spp.
FDINSRWHFGWDVLAQTDHNFSRT

SEQ ID NO: 24919 - protein, 26 aa, Brucella spp.
NNRNYFDLNFYRFNVQESYLAGDPNE

SEQ ID NO: 24920 - protein, 26 aa, Brucella spp.
EMYSKQPWVFPSLDYSYTMPEPVYGG

SEQ ID NO: 24921 - protein, 19 aa, Brucella spp.
EWKRTFITPSGLVITPLLA

SEQ ID NO: 24922 - protein, 29 aa, Brucella spp.
MATAGLELRWPILFSTTSSTHILEPVAQI

SEQ ID NO: 24923 - protein, 30 aa, Brucella spp.
SGVTPEHFKKYIMVQMGWGRLVSARFRATG

SEQ ID NO: 24924 - protein, 29 aa, Brucella spp.
KPVATEYHLQQVIFVVPASKRSPALLAKR

SEQ ID NO: 24925 - protein, 31 aa, Brucella spp.
GLMQYMTPTMLFFFAIFIFHEPFSTAQLAAF

SEQ ID NO: 24926 - protein, 21 aa, Brucella spp.
QLAAFVLIWAGLALYTWSSLS

SEQ ID NO: 24927 - protein, 18 aa, Brucella spp.
CFVAKSWDYHVRLALGCT

SEQ ID NO: 24928 - protein, 36 aa, Brucella spp.
CGNANLVSLIPTLVLKPYWAERFELGIKPASLKSIT

SEQ ID NO: 24929 - protein, 25 aa, Brucella spp.
GMLNPQPEFFKVESFRCLVERRFDA

SEQ ID NO: 24930 - protein, 22 aa, Brucella spp.
EDFPPRYNIAPTQPILAILAGE

SEQ ID NO: 24931 - protein, 28 aa, Brucella spp.
NRPDRIAMLVRWGFVPAWVKDPNDWPLM

SEQ ID NO: 24932 - protein, 22 aa, Brucella spp.
KDPNDWPLMFNIRSETAAEKNS

SEQ ID NO: 24933 - protein, 18 aa, Brucella spp.
KGWLAFPGGGVEAGETPE

SEQ ID NO: 24934 - protein, 24 aa, Brucella spp.
NAYEKSYYLSVYRTLEISGTEQPG

SEQ ID NO: 24935 - protein, 30 aa, Brucella spp.
VGQQNEVYVWPYFYAMPLDKLTPPQIVELF

SEQ ID NO: 24936 - protein, 29 aa, Brucella spp.
ALLTPQGKILFDFLVSRIEGGLRFDLPAD

SEQ ID NO: 24937 - protein, 27 aa, Brucella spp.
VAGDFVKRITLYRLRAKAEIVQVPESL

SEQ ID NO: 24938 - protein, 24 aa, Brucella spp.
LLVDQIFNRLVPGASIEWQMLALL

SEQ ID NO: 24939 - protein, 25 aa, Brucella spp.
PGASIEWQMLALLHDAPEYVIGDMI

SEQ ID NO: 24940 - protein, 26 aa, Brucella spp.
TRLESAIHLRFSLPVSPPAKLKTLIK

SEQ ID NO: 24941 - protein, 19 aa, Brucella spp.
TLIFNDIVEPREGLVAPGE

SEQ ID NO: 24942 - protein, 28 aa, Brucella spp.
RALIDFVQGWPRKAPLLIHCYAGISRST

SEQ ID NO: 24943 - protein, 17 aa, Brucella spp.
PLLIHCYAGISRSTAAA

SEQ ID NO: 24944 - protein, 23 aa, Brucella spp.
PSATPNIRLISIADTMLGRRGRM

SEQ ID NO: 24945 - protein, 27 aa, Brucella spp.
AGELLLRFEVMMLEELGFGLDLKECAA

SEQ ID NO: 24946 - protein, 28 aa, Brucella spp.
DRAFTMTGYFLMRHVWEPRAQTPPDSRS

SEQ ID NO: 24947 - protein, 26 aa, Brucella spp.
TRALVRGIFIEGPAQIVLVDTPGIFR

SEQ ID NO: 24948 - protein, 23 aa, Brucella spp.
AKDADIILVIIDAQGGFNENAEA

SEQ ID NO: 24949 - protein, 17 aa, Brucella spp.
VPFDRTFMISALNGSGC

SEQ ID NO: 24950 - protein, 23 aa, Brucella spp.
TREKLYLRLHEELPYASTVETER

SEQ ID NO: 24951 - protein, 25 aa, Brucella spp.
ILEQTVHQFLFVKVRENWGNDPERY

SEQ ID NO: 24952 - protein, 20 aa, Brucella spp.
RTGHRFLNLKRLERALTHSS

SEQ ID NO: 24953 - protein, 19 aa, Brucella spp.
NYERLEFLGDRVLGLTVAE

SEQ ID NO: 24954 - protein, 19 aa, Brucella spp.
EFLGDRVLGLTVAEMLFEA

SEQ ID NO: 24955 - protein, 24 aa, Brucella spp.
EAARSFIQRYWKKRSLETGAARRD

SEQ ID NO: 24956 - protein, 25 aa, Brucella spp.
GPDHDPLFLVEVTVKGFAPEKGEGR

SEQ ID NO: 24957 - protein, 17 aa, Brucella spp.
IAEGVFWRDMGVVNTPS

SEQ ID NO: 24958 - protein, 28 aa, Brucella spp.
SAFTPFFGFHLIIAIVLAYFLAGNVAAA

SEQ ID NO: 24959 - protein, 23 aa, Brucella spp.
ANPLTLPFIWGSTFELGRFIMSG

SEQ ID NO: 24960 - protein, 24 aa, Brucella spp.
KENYSLSFWQIGLLTFTFQMTASI

SEQ ID NO: 24961 - protein, 26 aa, Brucella spp.
VAALIGMFVLWYVGNWYNRYRLANAN

SEQ ID NO: 24962 - protein, 19 aa, Brucella spp.
LVFTKYIYMASLTSYYTFY

SEQ ID NO: 24963 - protein, 17 aa, Brucella spp.
TSQLLLFLFLGAVAAGT

SEQ ID NO: 24964 - protein, 18 aa, Brucella spp.
QLLLFLFLGAVAAGTIIG

SEQ ID NO: 24965 - protein, 30 aa, Brucella spp.
IEFVYRICSYLPFLGLLTIFLPKLERRRKA

SEQ ID NO: 24966 - protein, 35 aa, Brucella spp.
AGAILEGHFILTSGLRSPVFLQKARVFMHADKTEK

SEQ ID NO: 24967 - protein, 24 aa, Brucella spp.
ENGVFRLRRFDVPKGARVVIVEDI

SEQ ID NO: 24968 - protein, 25 aa, Brucella spp.
ASGDPYFSHPLEVAAILTDMHLDEA

SEQ ID NO: 24969 - protein, 20 aa, Brucella spp.
AAILTDMHLDEATIAIALLH

SEQ ID NO: 24970 - protein, 35 aa, Brucella spp.
AENLRKLLLAISEDVRVLLVKLADRLHNMRTLGVM

SEQ ID NO: 24971 - protein, 25 aa, Brucella spp.
EELEELAFRYINPDAWRAVTDRLAE

SEQ ID NO: 24972 - protein, 26 aa, Brucella spp.
DCYRALGLIHTTWSMVPGRFKDYIST

SEQ ID NO: 24973 - protein, 28 aa, Brucella spp.
ELFQDQVFCFTPKGRLIALPRGATPIDF

SEQ ID NO: 24974 - protein, 17 aa, Brucella spp.
IALPRGATPIDFAYAVH

SEQ ID NO: 24975 - protein, 24 aa, Brucella spp.
KAGEKGWFNIQNAAGMIFKVPEGG

SEQ ID NO: 24976 - protein, 25 aa, Brucella spp.
QPGAGITIYPIQSPALTAYDDQPER

SEQ ID NO: 24977 - protein, 25 aa, Brucella spp.
APDFTEMIIDVEVWDLKHLNRIISQ

SEQ ID NO: 24978 - protein, 28 aa, Brucella spp.
CVDKVENRFELVLLAGHRARQISQGAPI

SEQ ID NO: 24979 - protein, 17 aa, Brucella spp.
AWHNAPVPPFLPGSDED

SEQ ID NO: 24980 - protein, 24 aa, Brucella spp.
GSDEDVRLLIVGLAPGLRGANRTG

SEQ ID NO: 24981 - protein, 28 aa, Brucella spp.
EINNCRQFLTPMLTRFPNLDAVVTLGTI

SEQ ID NO: 24982 - protein, 25 aa, Brucella spp.
RGSLDRQILTWAIATSGMDGVPSTE

SEQ ID NO: 24983 - protein, 20 aa, Brucella spp.
QRRLLHSLYNGHLQSARLLA

SEQ ID NO: 24984 - protein, 30 aa, Brucella spp.
DRSWQANPVYQFLKIRYLRRAERYNEAAEL

SEQ ID NO: 24985 - protein, 28 aa, Brucella spp.
LVDPDAWWVERRILSRELLDLGKPQLAY

SEQ ID NO: 24986 - protein, 18 aa, Brucella spp.
FHAGWYALRALNQPKLAA

SEQ ID NO: 24987 - protein, 22 aa, Brucella spp.
EQVVDWIERIPYSETRNYVQRV

SEQ ID NO: 24988 - protein, 25 aa, Brucella spp.
ELTAKYINILWDDGPHKYNVRSFLG

SEQ ID NO: 24989 - protein, 21 aa, Brucella spp.
PFSMLNQVRFRQIWNEAKAEV

SEQ ID NO: 24990 - protein, 27 aa, Brucella spp.
GIDIRRVQMWLGHQTLQMTMRYAHLAT

SEQ ID NO: 24991 - protein, 19 aa, Brucella spp.
ARMHTCLDQYHALKDANAL

SEQ ID NO: 24992 - protein, 24 aa, Brucella spp.
NALGGLKWVQKGGGYYSLCNARLK

SEQ ID NO: 24993 - protein, 17 aa, Brucella spp.
RLRLRKLMRGAERMLLQ

SEQ ID NO: 24994 - protein, 22 aa, Brucella spp.
TRLDLFGHYLREQIRLLMRNHG

SEQ ID NO: 24995 - protein, 35 aa, Brucella spp.
ATSASHFQNFVLFTNYQFYMDEFCAYARQLMAEGG

SEQ ID NO: 24996 - protein, 22 aa, Brucella spp.
HIAVLRPHAWLMLGHCAGLRNS

SEQ ID NO: 24997 - protein, 27 aa, Brucella spp.
HVLDDDLPVWVPLPALAEIQVALEEAV

SEQ ID NO: 24998 - protein, 23 aa, Brucella spp.
AANGFRFRVPYGTLLCVSDKPLH

SEQ ID NO: 24999 - protein, 19 aa, Brucella spp.
PFLILVAATLVSIPLVLSF

SEQ ID NO: 25000 - protein, 27 aa, Brucella spp.
HLRIHLAVLMGLLALPLLFTKLRREGA

SEQ ID NO: 25001 - protein, 21 aa, Brucella spp.
EGAMILLLAVFAIAVTPHVFP

SEQ ID NO: 25002 - protein, 17 aa, Brucella spp.
VAALHLHWPWPFQQSEQ

SEQ ID NO: 25003 - protein, 21 aa, Brucella spp.
ALHLHWPWPFQQSEQIEALSE

SEQ ID NO: 25004 - protein, 24 aa, Brucella spp.
PPTGPTWLYRRLPASLRFAGLPID

SEQ ID NO: 25005 - protein, 24 aa, Brucella spp.
PVTADHFLVLGPAGSVRLPNFAMP

SEQ ID NO: 25006 - protein, 19 aa, Brucella spp.
YHLEDNMVAVGFVLHLNYK

SEQ ID NO: 25007 - protein, 27 aa, Brucella spp.
NMVAVGFVLHLNYKNPYLSPFEEFQRF

SEQ ID NO: 25008 - protein, 24 aa, Brucella spp.
VRNVKPLWSKFGTAIGIALGGLDM

SEQ ID NO: 25009 - protein, 31 aa, Brucella spp.
IALGGLDMWTNQLFGFSFFGTMKHGKTDAQA

SEQ ID NO: 25010 - protein, 27 aa, Brucella spp.
PTGMEIPVMPTLHPAYLLRTPAQKRFA

SEQ ID NO: 25011 - protein, 28 aa, Brucella spp.
ESRGMIFSIYMIITMVGLLLGQYILPFG

SEQ ID NO: 25012 - protein, 22 aa, Brucella spp.
FVDRRYMMILAGAIGFTLSFIM

SEQ ID NO: 25013 - protein, 26 aa, Brucella spp.
GFTLSFIMVLFHPTSPYTLYAMMFLF

SEQ ID NO: 25014 - protein, 27 aa, Brucella spp.
TSPYTLYAMMFLFGSVVFPIYSLNVAH

SEQ ID NO: 25015 - protein, 27 aa, Brucella spp.
AEGFRRITYFYDRPDVLSVYTVRVDAD

SEQ ID NO: 25016 - protein, 35 aa, Brucella spp.
PERHFAVWHDPHPKPSYLFALVAGSLGVVKDHFTT

SEQ ID NO: 25017 - protein, 20 aa, Brucella spp.
REYDLNVFNIVAVSDFNMGA

SEQ ID NO: 25018 - protein, 18 aa, Brucella spp.
NVFNIVAVSDFNMGAMEN

SEQ ID NO: 25019 - protein, 25 aa, Brucella spp.
RITCRDWFQLCLKEGLTVYRDHEFS

SEQ ID NO: 25020 - protein, 28 aa, Brucella spp.
KGSEVVRMIRTIIGPELFRKGMDLYFER

SEQ ID NO: 25021 - protein, 18 aa, Brucella spp.
LFRKGMDLYFERHDGDAA

SEQ ID NO: 25022 - protein, 24 aa, Brucella spp.
QDFSQFALWYDQAGTPKVEAGFHH

SEQ ID NO: 25023 - protein, 27 aa, Brucella spp.
PGQSIRKPMHIPIAFGLIGPDGKDMQP

SEQ ID NO: 25024 - protein, 26 aa, Brucella spp.
FGQDALVMDKWFIVQATRPGETALEA

SEQ ID NO: 25025 - protein, 43 aa, Brucella spp.
PAYSKFIVIEPILRRLVPTLIIIFLIILGVARVFSLLAWRDDI

SEQ ID NO: 25026 - protein, 25 aa, Brucella spp.
LGDAQPLFLFAERAGVLRVVLQGEA

SEQ ID NO: 25027 - protein, 27 aa, Brucella spp.
FAGTIGVMFAILYAYFSQAARAREADD

SEQ ID NO: 25028 - protein, 23 aa, Brucella spp.
GRCGLWDWDMARGRIYWSRSMYE

SEQ ID NO: 25029 - protein, 25 aa, Brucella spp.
DEAKHPWYMRLRTSLFRTFDYYVRV

SEQ ID NO: 25030 - protein, 28 aa, Brucella spp.
LLCVAWTFYVLARFAYIYLFYPEMGTGS

SEQ ID NO: 25031 - protein, 42 aa, Brucella spp.
GSAEGIYLFPLFYPTLGFALLLFIRRPFLIAVAFMAISLVIL

SEQ ID NO: 25032 - protein, 17 aa, Brucella spp.
LIAVAFMAISLVILIFG

SEQ ID NO: 25033 - protein, 20 aa, Brucella spp.
AFMAISLVILIFGFHYDLSW

SEQ ID NO: 25034 - protein, 19 aa, Brucella spp.
AIRYGFLGLLFYGVLTVWA

SEQ ID NO: 25035 - protein, 19 aa, Brucella spp.
LFFERNLCALTPLDPERAS

SEQ ID NO: 25036 - protein, 18 aa, Brucella spp.
SDIDLIVFIDETKPAIGD

SEQ ID NO: 25037 - protein, 26 aa, Brucella spp.
LAELSPYVWRKYLDYAAIADVHSIKR

SEQ ID NO: 25038 - protein, 25 aa, Brucella spp.
ALAQEYWFLRDVEHRIQMIADEQTH

SEQ ID NO: 25039 - protein, 20 aa, Brucella spp.
SLLRFDGFLQGLPAGIQLFS

SEQ ID NO: 25040 - protein, 26 aa, Brucella spp.
LPAGIQLFSLLQSNPRLLNLLVMIMS

SEQ ID NO: 25041 - protein, 28 aa, Brucella spp.
QSNPRLLNLLVMIMSAAPRLADIITRNP

SEQ ID NO: 25042 - protein, 34 aa, Brucella spp.
EVLDRLRIFAAEHRFLIGIRLLTGAINGVRAGQA

SEQ ID NO: 25043 - protein, 25 aa, Brucella spp.
LAPSKYYIRLTQRLIAALSAPTAEG

SEQ ID NO: 25044 - protein, 19 aa, Brucella spp.
IIDLEFIAQFATLAGYVKK

SEQ ID NO: 25045 - protein, 17 aa, Brucella spp.
EFIAQFATLAGYVKKTP

SEQ ID NO: 25046 - protein, 22 aa, Brucella spp.
RIEYELLEHYRLVRAAFDKLVG

SEQ ID NO: 25047 - protein, 30 aa, Brucella spp.
VDITLQPREFRLLEYLMRHAGQVVTRTMLL

SEQ ID NO: 25048 - protein, 25 aa, Brucella spp.
QVVTRTMLLENVWDYHFDPQTNVID

SEQ ID NO: 25049 - protein, 32 aa, Brucella spp.
RFNAQTALLWGFPVIILLIGGGALLVAFRRRR

SEQ ID NO: 25050 - protein, 28 aa, Brucella spp.
NHEGSMLLWVFILTLFSALVAAFSGNLP

SEQ ID NO: 25051 - protein, 26 aa, Brucella spp.
IGTAFLAFIIFTSNPFTRIFPAPMEG

SEQ ID NO: 25052 - protein, 32 aa, Brucella spp.
LDAAWARWVRPWALMAWMFLTGGIAMGSYWAY

SEQ ID NO: 25053 - protein, 25 aa, Brucella spp.
AMGSYWAYYELGWGGWWFWDPVENA

SEQ ID NO: 25054 - protein, 23 aa, Brucella spp.
GWGGWWFWDPVENASLMPWLVGT

SEQ ID NO: 25055 - protein, 25 aa, Brucella spp.
MTFGPLMVPLLFAVPFGPLLAWKRG

SEQ ID NO: 25056 - protein, 32 aa, Brucella spp.
NGAVVVRIWWKPLVTLIWYGALVMMLGGLFSL

SEQ ID NO: 25057 - protein, 26 aa, Brucella spp.
SQRKRKRLFLIGGALAVLAVAVGLML

SEQ ID NO: 25058 - protein, 23 aa, Brucella spp.
LTAFNQDIRFFRTPADLTEQDMT

SEQ ID NO: 25059 - protein, 17 aa, Brucella spp.
RFFRTPADLTEQDMTSG

SEQ ID NO: 25060 - protein, 21 aa, Brucella spp.
LLTFAATLAVLLPLTRRRQAA

SEQ ID NO: 25061 - protein, 39 aa, Brucella spp.
GRSGRVLAFVAVLAVPLVAWGIYPLFGAPDMPSMPLAPR

SEQ ID NO: 25062 - protein, 26 aa, Brucella spp.
GDVRGWDVLAPIYLRLGRASDAVSAY

SEQ ID NO: 25063 - protein, 26 aa, Brucella spp.
WRRSGRTIPVLMLTARDRWSDKVAGI

SEQ ID NO: 25064 - protein, 23 aa, Brucella spp.
YVAKPFHIEEVLARLRALIRRAA

SEQ ID NO: 25065 - protein, 19 aa, Brucella spp.
HEYRLLSYMMHHMDEVVSR

SEQ ID NO: 25066 - protein, 20 aa, Brucella spp.
KVFALLAVSVGLLPVNAGAL

SEQ ID NO: 25067 - protein, 24 aa, Brucella spp.
MQNGRAMCVIVVLIPGRNGERPRR

SEQ ID NO: 25068 - protein, 26 aa, Brucella spp.
LRSLDDLRMVLAFFEARRGSLHAFRF

SEQ ID NO: 25069 - protein, 27 aa, Brucella spp.
SSMMGGLLSGIRGIMPFAKGGVVSSPT

SEQ ID NO: 25070 - protein, 22 aa, Brucella spp.
VSSPTYFGMGNGSLGLAGEAGA

SEQ ID NO: 25071 - protein, 21 aa, Brucella spp.
SKPVQVVFNMTSPDASSFRKS

SEQ ID NO: 25072 - protein, 27 aa, Brucella spp.
RLDGRDWTLCLTLGALAELESVFETDN

SEQ ID NO: 25073 - protein, 19 aa, Brucella spp.
FAHIVSSLLTVTFGTSEKD

SEQ ID NO: 25074 - protein, 27 aa, Brucella spp.
ASDALIRRIFFDGEIRDWQIVLPDFGT

SEQ ID NO: 25075 - protein, 25 aa, Brucella spp.
GEIRDWQIVLPDFGTISGPFQITAL

SEQ ID NO: 25076 - protein, 25 aa, Brucella spp.
LASDTAWLWFAKIAGAVAGSAVSLA

SEQ ID NO: 25077 - protein, 28 aa, Brucella spp.
VEGGSFFERLYGHLLIAGNAYVERVDLP

SEQ ID NO: 25078 - protein, 27 aa, Brucella spp.
DAPGLHLKLFHPLDDHYGFPPLEAALM

SEQ ID NO: 25079 - protein, 21 aa, Brucella spp.
DIALAFGVPPMLLGIPGDNTY

SEQ ID NO: 25080 - protein, 27 aa, Brucella spp.
YAEANRAFYRLTVLPLIGRTAKAFGNW

SEQ ID NO: 25081 - protein, 27 aa, Brucella spp.
QLPPDGDWRVWLIMGGRGSGKTRAGAE

SEQ ID NO: 25082 - protein, 25 aa, Brucella spp.
EASRRRLIWDNGAVATLFSSEDPDS

SEQ ID NO: 25083 - protein, 25 aa, Brucella spp.
NPQETWDMLQFGLRLGDNPRQVVTT

SEQ ID NO: 25084 - protein, 17 aa, Brucella spp.
VPLLKALLTDRTVSMTH

SEQ ID NO: 25085 - protein, 26 aa, Brucella spp.
RSPDRLDALVWALGELMLGADHKPRI

SEQ ID NO: 25086 - protein, 22 aa, Brucella spp.
QRHERIRLAYQLQVRHGITAED

SEQ ID NO: 25087 - protein, 26 aa, Brucella spp.
LSEERYDLWLRRLKCTGSEAKAPQRP

SEQ ID NO: 25088 - protein, 27 aa, Brucella spp.
LIGAAIVHIAIVFLVPVYSDKNAWSRI

SEQ ID NO: 25089 - protein, 27 aa, Brucella spp.
PVEISAPLLLRSPLLRPSDLVDIIARN

SEQ ID NO: 25090 - protein, 22 aa, Brucella spp.
LVRALQQPFFTAGALPGCEHLI

SEQ ID NO: 25091 - protein, 17 aa, Brucella spp.
LIDSQLFRTALADALDI

SEQ ID NO: 25092 - protein, 25 aa, Brucella spp.
IIGKWPDSYLPIALKALGLSAPECY

SEQ ID NO: 25093 - protein, 23 aa, Brucella spp.
DGLRDFVHIYRSIDRAKAMSLVR

SEQ ID NO: 25094 - protein, 24 aa, Brucella spp.
SDGERMFLRILHNADDMAANTRME

SEQ ID NO: 25095 - protein, 26 aa, Brucella spp.
SLAARLLHFFFTSASVLAIAAGDFVV

SEQ ID NO: 25096 - protein, 25 aa, Brucella spp.
GATAFLVVMGFVSANALWYQPEAHD

SEQ ID NO: 25097 - protein, 26 aa, Brucella spp.
PEAHDAVFFRTRPDFVFKPTPRAALP

SEQ ID NO: 25098 - protein, 22 aa, Brucella spp.
AFWLSLAFIAVPHFFPADQENK

SEQ ID NO: 25099 - protein, 25 aa, Brucella spp.
MQRAALQIIAGIDMDLLMKASKEEK

SEQ ID NO: 25100 - protein, 24 aa, Brucella spp.
APNHNLLIWGYDDKGSEFYKLKVR

SEQ ID NO: 25101 - protein, 18 aa, Brucella spp.
RLILSHSAYKHHLVWIER

SEQ ID NO: 25102 - protein, 25 aa, Brucella spp.
AYKHHLVWIERDNGLPRIVIHDRKT

SEQ ID NO: 25103 - protein, 25 aa, Brucella spp.
LDGSAPCLLYGYGSYGITIPASFST

SEQ ID NO: 25104 - protein, 20 aa, Brucella spp.
NTMLDDTLPLTPPEWPEWGN

SEQ ID NO: 25105 - protein, 26 aa, Brucella spp.
AKQLEYSWVLSLMGAYSDFWKLTEES

SEQ ID NO: 25106 - protein, 27 aa, Brucella spp.
RPSFCQACIFWIESQKFEPDFYRDTPD

SEQ ID NO: 25107 - protein, 26 aa, Brucella spp.
IDTANRFCYLVLDNGQALRYGVGIGR

SEQ ID NO: 25108 - protein, 20 aa, Brucella spp.
AVIQYKRQWPRWTPPDEMVA

SEQ ID NO: 25109 - protein, 25 aa, Brucella spp.
TAEKAVGMILAFLQKEGPADKVQQL

SEQ ID NO: 25110 - protein, 18 aa, Brucella spp.
GFLSNLVGGVMGLGTQLM

SEQ ID NO: 25111 - protein, 26 aa, Brucella spp.
ARISRDLRYWMARRETAELSVPAPDS

SEQ ID NO: 25112 - protein, 25 aa, Brucella spp.
SRGKISHVAPVSILLFGKPVGDVVK

SEQ ID NO: 25113 - protein, 27 aa, Brucella spp.
ALECGSHWPFQQPVLVKLAQSGRQPTP

SEQ ID NO: 25114 - protein, 25 aa, Brucella spp.
AKAAQRLIHACMAEPFYVAGTKRAC

SEQ ID NO: 25115 - protein, 23 aa, Brucella spp.
KRACTELMRMAPGRIFVKTGAEG

SEQ ID NO: 25116 - protein, 19 aa, Brucella spp.
PALAHHYFGGKDKLILATM

SEQ ID NO: 25117 - protein, 23 aa, Brucella spp.
AQETIAAWLTFYVHAQQSDDIKR

SEQ ID NO: 25118 - protein, 28 aa, Brucella spp.
DDIKRLLRIYARRLHSNLVFALEQLTSR

SEQ ID NO: 25119 - protein, 23 aa, Brucella spp.
SAADALEFFGGIISGFNGEFVEL

SEQ ID NO: 25120 - protein, 34 aa, Brucella spp.
RREALGICVGIGAWNYPIQIAAWKSAPALAMGNA

SEQ ID NO: 25121 - protein, 24 aa, Brucella spp.
AMGNAFIFKPSENTPLSALALAEA

SEQ ID NO: 25122 - protein, 25 aa, Brucella spp.
QGFDKGFFIEPTVFADVTDTMTIAR

SEQ ID NO: 25123 - protein, 25 aa, Brucella spp.
QIKAGTCWINAYNLTPVEVPFGGYK

SEQ ID NO: 25124 - protein, 31 aa, Brucella spp.
NLARGRLYQFDFILPDNENTFMLSLRSELYA

SEQ ID NO: 25125 - protein, 20 aa, Brucella spp.
DRVLRPCILWNDTRSYREAA

SEQ ID NO: 25126 - protein, 25 aa, Brucella spp.
AITGNTVFPSFTAPKLVWVARNEAD

SEQ ID NO: 25127 - protein, 38 aa, Brucella spp.
NEADIFARIRKVLLPKDYLRLWLTGEYISDMSDSAGTS

SEQ ID NO: 25128 - protein, 20 aa, Brucella spp.
PRTWHQMGVILSAASALEWY

SEQ ID NO: 25129 - protein, 25 aa, Brucella spp.
GGSRSTYWLKAIATALNVPIALPEE

SEQ ID NO: 25130 - protein, 29 aa, Brucella spp.
LGKRMEDHLRFAVAYWHSFAWEGGDPFGG

SEQ ID NO: 25131 - protein, 28 aa, Brucella spp.
KLKADVAFEFFSLLGAPYYCFHDADVRP

SEQ ID NO: 25132 - protein, 20 aa, Brucella spp.
EMALAYYQVLLAGGFTTGGT

SEQ ID NO: 25133 - protein, 30 aa, Brucella spp.
HATFSGALAWPFVYPWPQRPAGLVETAFDE

SEQ ID NO: 25134 - protein, 19 aa, Brucella spp.
DELARRWMPILDHADEHGV

SEQ ID NO: 25135 - protein, 20 aa, Brucella spp.
SHYVLQCLDYLDNIDIYKDR

SEQ ID NO: 25136 - protein, 17 aa, Brucella spp.
IYKDRIKMFHVKDAEFN

SEQ ID NO: 25137 - protein, 27 aa, Brucella spp.
SSQADVIHYHFPWPMSDIVQIGVRPDK

SEQ ID NO: 25138 - protein, 26 aa, Brucella spp.
IVKQKLLLQFYRPLMNRFLGSVDRIV

SEQ ID NO: 25139 - protein, 31 aa, Brucella spp.
KARWRERFPRPFFLFVGVLRYYKGLRTLLAA

SEQ ID NO: 25140 - protein, 18 aa, Brucella spp.
SWLHNDALPLWLSAGVDA

SEQ ID NO: 25141 - protein, 26 aa, Brucella spp.
PLCSNPHMHLFEAMLAWETVDPETQF

SEQ ID NO: 25142 - protein, 24 aa, Brucella spp.
EPGHQFEWSWLMGQWADRRQNGDG

SEQ ID NO: 25143 - protein, 26 aa, Brucella spp.
HDSLARLWPQTEWIKSALLFASLSKD

SEQ ID NO: 25144 - protein, 27 aa, Brucella spp.
AIDALRPFLETPIKGLWYDKWPEGGTL

SEQ ID NO: 25145 - protein, 26 aa, Brucella spp.
SQRPKQFLALTGELSLFQMTLKRLSD

SEQ ID NO: 25146 - protein, 18 aa, Brucella spp.
RYSSPIIITNADYRFLVA

SEQ ID NO: 25147 - protein, 19 aa, Brucella spp.
IITNADYRFLVAEQALECG

SEQ ID NO: 25148 - protein, 32 aa, Brucella spp.
MLAAGGFYWNSGMFLFRSDVFLDECRRYAPAV

SEQ ID NO: 25149 - protein, 25 aa, Brucella spp.
AEEHRTIYRPWGGYTHLLSGDRLQV

SEQ ID NO: 25150 - protein, 20 aa, Brucella spp.
RLQVKRLFIKPGKQLSLQKH

SEQ ID NO: 25151 - protein, 23 aa, Brucella spp.
NPGKILLELIEVQTGAYLGEDDI

SEQ ID NO: 25152 - protein, 28 aa, Brucella spp.
FQGPAGRLFWSQTVLPLQLRKDRIDVFW

SEQ ID NO: 25153 - protein, 17 aa, Brucella spp.
DVFWGPAHRLPALKGAI

SEQ ID NO: 25154 - protein, 25 aa, Brucella spp.
VVSIHDLVWYYASSTMRLQGWLADR

SEQ ID NO: 25155 - protein, 20 aa, Brucella spp.
LQGWLADRFLMKGALRNADQ

SEQ ID NO: 25156 - protein, 18 aa, Brucella spp.
EPRKNLIRLLEAYANLPE

SEQ ID NO: 25157 - protein, 24 aa, Brucella spp.
RNARTLLMPSLYEGFGLPIIEAQA

SEQ ID NO: 25158 - protein, 24 aa, Brucella spp.
RNDPYMDIPVYSPYLCGNFKKYVN

SEQ ID NO: 25159 - protein, 25 aa, Brucella spp.
GDEVIVPTFTYIASVNTILQTGATP

SEQ ID NO: 25160 - protein, 25 aa, Brucella spp.
TSPTREYWHDALAYNYRMTNIQAAI

SEQ ID NO: 25161 - protein, 24 aa, Brucella spp.
NGVDTRPFFPPAHRMPHSASTGSY

SEQ ID NO: 25162 - protein, 19 aa, Brucella spp.
LCGIGLFLLSHLLPANFLA

SEQ ID NO: 25163 - protein, 24 aa, Brucella spp.
VNMQLFLCLSGASLLLWVVGGLDD

SEQ ID NO: 25164 - protein, 33 aa, Brucella spp.
GLGPDFRLLPNLLPYWLEATLIVFALIIAINVT

SEQ ID NO: 25165 - protein, 24 aa, Brucella spp.
RETHIVVALVLPLYYILDAGTTIV

SEQ ID NO: 25166 - protein, 23 aa, Brucella spp.
KQIILVLSDCLLLLASAYLAFVV

SEQ ID NO: 25167 - protein, 50 aa, Brucella spp.
LAFVVRFGFVFVPNLAQLFLILIAPLLAIPVFIRFGLYRAIIRYLAERAI

SEQ ID NO: 25168 - protein, 27 aa, Brucella spp.
ATAVAALFWVALVFLMELYGSTGLPRS

SEQ ID NO: 25169 - protein, 29 aa, Brucella spp.
TGLPRSVPLLYWLLSTVFISASRFGAKWL

SEQ ID NO: 25170 - protein, 24 aa, Brucella spp.
PFGSQAFIPLNGRPFLVVVAEDAG

SEQ ID NO: 25171 - protein, 26 aa, Brucella spp.
QGVNYLRNIWHHPLLALEQKSDFLVV

SEQ ID NO: 25172 - protein, 25 aa, Brucella spp.
DHRILDVLVKDRIPATIFVTGRWIK

SEQ ID NO: 25173 - protein, 19 aa, Brucella spp.
HVPAITNMPLMYGIKTAGS

SEQ ID NO: 25174 - protein, 24 aa, Brucella spp.
EGMPKPLWYRDATARYSTDAVQLA

SEQ ID NO: 25175 - protein, 27 aa, Brucella spp.
FAYDSYRRFIQMYSDVVLGVDHGFFEE

SEQ ID NO: 25176 - protein, 25 aa, Brucella spp.
NARAITYRRLHNIPAAWGTAVNVQA

SEQ ID NO: 25177 - protein, 26 aa, Brucella spp.
DMQDLEFTIERGKLWMLQTRSGKRTA

SEQ ID NO: 25178 - protein, 23 aa, Brucella spp.
GLCRTEHMFFDGSRIVAMREMIL

SEQ ID NO: 25179 - protein, 19 aa, Brucella spp.
ALGKLLPMQRSDFAELFEI

SEQ ID NO: 25180 - protein, 38 aa, Brucella spp.
MQRSDFAELFEIMKGLPVTIRLLDPPLHEFLPHTDEEV

SEQ ID NO: 25181 - protein, 25 aa, Brucella spp.
EPVVPEVMVPLVSLKAELDFVKARI

SEQ ID NO: 25182 - protein, 24 aa, Brucella spp.
AGIKIDYMVGTMIELPRAALRAAE

SEQ ID NO: 25183 - protein, 27 aa, Brucella spp.
KNTPISRLWIAFGLTGIFMIAEVIGSF

SEQ ID NO: 25184 - protein, 23 aa, Brucella spp.
AFNALLLLGVAFYILYEAWERLS

SEQ ID NO: 25185 - protein, 26 aa, Brucella spp.
AVGIGFMVFPRTWVLLKECINILLEG

SEQ ID NO: 25186 - protein, 25 aa, Brucella spp.
TGKARLIFRDFPFDPRATAAVMLAR

SEQ ID NO: 25187 - protein, 30 aa, Brucella spp.
RCAPEDHYFPMIDLFFRQQQQWATAEDGKA

SEQ ID NO: 25188 - protein, 23 aa, Brucella spp.
RWYDRHHRVLPWRVTPVDAAKGD

SEQ ID NO: 25189 - protein, 24 aa, Brucella spp.
VADPYRVWLSEIMLQQTTVEAVKS

SEQ ID NO: 25190 - protein, 27 aa, Brucella spp.
VEAVKSYFLRFIERWPTVRAMAKASED

SEQ ID NO: 25191 - protein, 29 aa, Brucella spp.
VVFDIGKVLIHYDPELAFLDIIPDAGERR

SEQ ID NO: 25192 - protein, 25 aa, Brucella spp.
DAGERRWFLENICTSAWNIEQDRGR

SEQ ID NO: 25193 - protein, 31 aa, Brucella spp.
RVGTQLQDLGFWLLNDIVWRKTNPMPNFRGR

SEQ ID NO: 25194 - protein, 18 aa, Brucella spp.
QMRSDWLFPICTGSERLK

SEQ ID NO: 25195 - protein, 25 aa, Brucella spp.
ACNGWTFWHFEENGVLKPIDALRKI

SEQ ID NO: 25196 - protein, 29 aa, Brucella spp.
PMAGGILMGVLIWVLARWRKRPIVDPIEA

SEQ ID NO: 25197 - protein, 24 aa, Brucella spp.
LTGSFYAFELIIGVYSIATLAPVV

SEQ ID NO: 25198 - protein, 25 aa, Brucella spp.
DYVPALMLGFISAGIAILIMRGVTL

SEQ ID NO: 25199 - protein, 29 aa, Brucella spp.
LDLNANITIPVLVLLILTKSLASAVSIGS

SEQ ID NO: 25200 - protein, 19 aa, Brucella spp.
GLFFASLFLGALTGKLFAA

SEQ ID NO: 25201 - protein, 23 aa, Brucella spp.
SSLFPVFATVLLASLAGCTTSGT

SEQ ID NO: 25202 - protein, 22 aa, Brucella spp.
KYKTRTIVMPIRVAIRQGDQVV

SEQ ID NO: 25203 - protein, 17 aa, Brucella spp.
VMPIRVAIRQGDQVVYS

SEQ ID NO: 25204 - protein, 23 aa, Brucella spp.
DTATQFVFNDKGVTIPMPDKQNV

SEQ ID NO: 25205 - protein, 24 aa, Brucella spp.
SYYARVLRNDMPLAIDILSDILTA

SEQ ID NO: 25206 - protein, 28 aa, Brucella spp.
EGRAYHVRDFYASQLLSMILGGGMSSRL

SEQ ID NO: 25207 - protein, 30 aa, Brucella spp.
KRGLCYSVYAFHWGFSDTGLFGIHAATGRD

SEQ ID NO: 25208 - protein, 20 aa, Brucella spp.
QIARQFLLYGRPVENSELLD

SEQ ID NO: 25209 - protein, 17 aa, Brucella spp.
AGRLFLNNKPTIAGVGP

SEQ ID NO: 25210 - protein, 27 aa, Brucella spp.
SDEGAMGFIINQLQPVQFPDLLRQIGV

SEQ ID NO: 25211 - protein, 25 aa, Brucella spp.
EGKYSRLMLHMGIDMSRLVSDAGHA

SEQ ID NO: 25212 - protein, 20 aa, Brucella spp.
APFILAVLAIPAQASTSAWT

SEQ ID NO: 25213 - protein, 24 aa, Brucella spp.
GMCENICVPVLAEFDFPLDADRQK

SEQ ID NO: 25214 - protein, 27 aa, Brucella spp.
DVFKGRKVVLFAVPGAFTPTCSLNHLP

SEQ ID NO: 25215 - protein, 24 aa, Brucella spp.
GGEGKILFLADGSATFTKAAGLDI

SEQ ID NO: 25216 - protein, 22 aa, Brucella spp.
TNNRMELMAAISALSALKEPCE

SEQ ID NO: 25217 - protein, 26 aa, Brucella spp.
ARKAHKVTWHWIKGHAGHPENERADE

SEQ ID NO: 25218 - protein, 28 aa, Brucella spp.
AGVDRAIQIVVLALKKYGAPVYVRHEIV

SEQ ID NO: 25219 - protein, 25 aa, Brucella spp.
DAEAKNLFYLDATCPLVSKVHKQAM

SEQ ID NO: 25220 - protein, 19 aa, Brucella spp.
QRLGRHVILIGHSGHPEVI

SEQ ID NO: 25221 - protein, 17 aa, Brucella spp.
GCDLFLIVGAPNSSNSK

SEQ ID NO: 25222 - protein, 24 aa, Brucella spp.
NVVTPWIFFIGLAIVLYCMFGWWS

SEQ ID NO: 25223 - protein, 24 aa, Brucella spp.
IASEVMFFVAWFWAFFDASLFPNE

SEQ ID NO: 25224 - protein, 34 aa, Brucella spp.
FEAAAWYWHFVDVVWLFLFFAIYVWGGWGAPMHG

SEQ ID NO: 25225 - protein, 26 aa, Brucella spp.
AALLAFTIFFYAVIYTMWLKRSTPQN

SEQ ID NO: 25226 - protein, 28 aa, Brucella spp.
TWDSLVLFMIIFLWTPPHFWALSLFTTN

SEQ ID NO: 25227 - protein, 24 aa, Brucella spp.
SAHALVMIFFMVMPALIGGFANWM

SEQ ID NO: 25228 - protein, 26 aa, Brucella spp.
PRMNNISFWLLPPALTLLLISLFMPG

SEQ ID NO: 25229 - protein, 30 aa, Brucella spp.
GGGDPILYQHLFWFFGHPEVYILIQPGFGI

SEQ ID NO: 25230 - protein, 24 aa, Brucella spp.
ISFRAPMLWAIGFIFLFTIGGVTG

SEQ ID NO: 25231 - protein, 26 aa, Brucella spp.
FAIFAGWYYWFPKMSGYMYNEFTAKL

SEQ ID NO: 25232 - protein, 24 aa, Brucella spp.
FTAKLHFWVTFVGVNLVFFPQHFL

SEQ ID NO: 25233 - protein, 17 aa, Brucella spp.
VFFPQHFLGLAGMPRRY

SEQ ID NO: 25234 - protein, 35 aa, Brucella spp.
GIAEQIHWFERYTLWFIIPITLLVLGLLVWVVLRF

SEQ ID NO: 25235 - protein, 27 aa, Brucella spp.
IWTVGPVIILLFLAVPSFQLLTAQYSP

SEQ ID NO: 25236 - protein, 27 aa, Brucella spp.
TADNKARILRVLAPLGVLLPNGLGLNV

SEQ ID NO: 25237 - protein, 28 aa, Brucella spp.
AKMPADVVSIFILPPTMRELQQRLNRRA

SEQ ID NO: 25238 - protein, 22 aa, Brucella spp.
QNARFEIQKWVKYDYIVINEDL

SEQ ID NO: 25239 - protein, 23 aa, Brucella spp.
GKGLDLRLRLPQGLESVEHPVRS

SEQ ID NO: 25240 - protein, 24 aa, Brucella spp.
GFAINQPMLAEVLKLGAELQEKYG

SEQ ID NO: 25241 - protein, 27 aa, Brucella spp.
RRQEGKALFTILSTHLDTIERLTADAR

SEQ ID NO: 25242 - protein, 41 aa, Brucella spp.
RHARSQIVVFMNFMLSLVVLVLLGASALFYFGKLQFDAQGP

SEQ ID NO: 25243 - protein, 24 aa, Brucella spp.
LISGKSIMYPFTVPEGLTVKQVFD

SEQ ID NO: 25244 - protein, 17 aa, Brucella spp.
PYNTYIINGLPPTPIAN

SEQ ID NO: 25245 - protein, 24 aa, Brucella spp.
AEMERQMRINEDVLSFLTVRVEEH

SEQ ID NO: 25246 - protein, 26 aa, Brucella spp.
VKDGYARNFLLPQGKALRANEANKKK

SEQ ID NO: 25247 - protein, 23 aa, Brucella spp.
AGKLRVLFRRFQQMNTISRSSSN

SEQ ID NO: 25248 - protein, 18 aa, Brucella spp.
LMKPDGVFLLHAIGRSDG

SEQ ID NO: 25249 - protein, 28 aa, Brucella spp.
PGATNPFIRKYIFPGGYIPALSEVLPHI

SEQ ID NO: 25250 - protein, 23 aa, Brucella spp.
VTDIEILRLHYAETLKAWREAFL

SEQ ID NO: 25251 - protein, 26 aa, Brucella spp.
LYDERFCRMWEFYLAASESAFRWQNM

SEQ ID NO: 25252 - protein, 26 aa, Brucella spp.
ASESAFRWQNMMVFHIQITHRQEAVP

SEQ ID NO: 25253 - protein, 38 aa, Brucella spp.
DAFYRVSDFLKPTHFLEPLHRRIYEIATDLIRVGKMAN

SEQ ID NO: 25254 - protein, 20 aa, Brucella spp.
LSIFQYVTRLATEAVTIINA

SEQ ID NO: 25255 - protein, 25 aa, Brucella spp.
QVMQKIPLYIDQTGGISIAQLAARA

SEQ ID NO: 25256 - protein, 24 aa, Brucella spp.
KRQRGLDVLVIDYVQLMTGSSKAS

SEQ ID NO: 25257 - protein, 22 aa, Brucella spp.
AKELNVPIIALSQLSRQVESRD

SEQ ID NO: 25258 - protein, 27 aa, Brucella spp.
EQDADVVLFVFREEYYVKNLEPRDKFD

SEQ ID NO: 25259 - protein, 27 aa, Brucella spp.
GSKRPDLVIIDSIQTLWTDMADSAPGT

SEQ ID NO: 25260 - protein, 25 aa, Brucella spp.
GEGGHHYRILRTVKNRFGPTDEIGV

SEQ ID NO: 25261 - protein, 22 aa, Brucella spp.
GTRPVLVEIQALVAPSSLGTPR

SEQ ID NO: 25262 - protein, 24 aa, Brucella spp.
WDGGRLAMILAVLESHCGVRFGQH

SEQ ID NO: 25263 - protein, 23 aa, Brucella spp.
ALPPDCVYFGEISLSGAVRAVSH

SEQ ID NO: 25264 - protein, 27 aa, Brucella spp.
GELWKDRNFRLMETAALADLVARIAAS

SEQ ID NO: 25265 - protein, 20 aa, Brucella spp.
AAVFLVVLIVVSLITMKIAD

SEQ ID NO: 25266 - protein, 18 aa, Brucella spp.
VVLIVVSLITMKIADFII

SEQ ID NO: 25267 - protein, 32 aa, Brucella spp.
AARGVLLVVVAMLFFNWLVPTNQPDWVTNAKS

SEQ ID NO: 25268 - protein, 27 aa, Brucella spp.
ENPQPERLCLFEYVYFARPDSVVGGRS

SEQ ID NO: 25269 - protein, 23 aa, Brucella spp.
IPFEYGIIRNHYVGRTFIEPTQQ

SEQ ID NO: 25270 - protein, 27 aa, Brucella spp.
HMRVASPMIFHPDFYGIDTPHADKLLA

SEQ ID NO: 25271 - protein, 20 aa, Brucella spp.
GIGYFLSLELAKRGAHVIAV

SEQ ID NO: 25272 - protein, 18 aa, Brucella spp.
RWGKLDILVANAGILGTI

SEQ ID NO: 25273 - protein, 32 aa, Brucella spp.
TFEKVMNINVTSVWRLIRSVDPLLRASDAGRA

SEQ ID NO: 25274 - protein, 28 aa, Brucella spp.
PAGAMLVLLPVYFGFLGLMPTRALAFGV

SEQ ID NO: 25275 - protein, 30 aa, Brucella spp.
LVRRDIVMPLILCVVIYVALLMSFTWQTLS

SEQ ID NO: 25276 - protein, 38 aa, Brucella spp.
FIAGFFVVSLMLGWLWDPLFWIGMVLTVWCIYFYRDPE

SEQ ID NO: 25277 - protein, 24 aa, Brucella spp.
IAGGLAFYWNSLTRTADAPKVDNA

SEQ ID NO: 25278 - protein, 28 aa, Brucella spp.
RDQIRNPDLIWPGQVFVMPKEPLRDNEV

SEQ ID NO: 25279 - protein, 33 aa, Brucella spp.
KHRKPMVFANINNFWQPMLALLDHMRAEGFIHT

SEQ ID NO: 25280 - protein, 25 aa, Brucella spp.
NLPDGQIYVPFTLPGEVVNVARDKN

SEQ ID NO: 25281 - protein, 26 aa, Brucella spp.
HWQDEPYRLWKRELVVGALKGRGTDV

SEQ ID NO: 25282 - protein, 26 aa, Brucella spp.
VEPKKPLIHFGKVPVPIPPGCFLQAT

SEQ ID NO: 25283 - protein, 30 aa, Brucella spp.
SIERRDLFRRPLMTKELLPYNAVVFDPPRA

SEQ ID NO: 25284 - protein, 27 aa, Brucella spp.
RIERVTPIDQFLWSAHVEAVAVLTKGR

SEQ ID NO: 25285 - protein, 21 aa, Brucella spp.
RPRLDQLLVERGFFATRSRAR

SEQ ID NO: 25286 - protein, 29 aa, Brucella spp.
DCIVSDVSFISLRLALPPALALAEKGAIC

SEQ ID NO: 25287 - protein, 35 aa, Brucella spp.
ELTVALHHVFNTPYDRIIWDVGHQAYPHKILTGRR

SEQ ID NO: 25288 - protein, 24 aa, Brucella spp.
ALDARLIVILNDNDMSIAPPTGAM

SEQ ID NO: 25289 - protein, 30 aa, Brucella spp.
FFTGGTLFEELGFYYVGPIDGHNLDHLLPV

SEQ ID NO: 25290 - protein, 26 aa, Brucella spp.
SEGYKPFCAIYSTFLQRGYDQVVHDV

SEQ ID NO: 25291 - protein, 21 aa, Brucella spp.
IQNLPVRFPIDRAGLVGADGP

SEQ ID NO: 25292 - protein, 24 aa, Brucella spp.
FGSHVLQFLATDGLLDRGFKVRAL

SEQ ID NO: 25293 - protein, 30 aa, Brucella spp.
PTARRRLVGPFIFFDRMGPAILRDGEALDV

SEQ ID NO: 25294 - protein, 26 aa, Brucella spp.
PLGSRRYIWWNFVASSKERIEQAKEE

SEQ ID NO: 25295 - protein, 27 aa, Brucella spp.
GGSLAKPVMIALGALLIGKLLKGNSDD

SEQ ID NO: 25296 - protein, 19 aa, Brucella spp.
ELLNQLSQVLPGLVDKLTA

SEQ ID NO: 25297 - protein, 27 aa, Brucella spp.
ATYGTLALFFIIYSESFGAPLPGESAL

SEQ ID NO: 25298 - protein, 24 aa, Brucella spp.
FGGRKLILRYGYLVKLTPERLNQF

SEQ ID NO: 25299 - protein, 23 aa, Brucella spp.
GAAGWTLIWGLGPYLLSGVLAPY

SEQ ID NO: 25300 - protein, 22 aa, Brucella spp.
DIAVMSFEDALKQLEKIVDDLE

SEQ ID NO: 25301 - protein, 24 aa, Brucella spp.
TRLYWHPIYLEHLTPPGHPERPDR

SEQ ID NO: 25302 - protein, 25 aa, Brucella spp.
LPALDNFRPDLILISAGFDAHFRDP

SEQ ID NO: 25303 - protein, 18 aa, Brucella spp.
LFRVTTWGESHGLALGCV

SEQ ID NO: 25304 - protein, 33 aa, Brucella spp.
DIDRSRWNWAEVDNNPFFTPDAGSVEVFADYLD

SEQ ID NO: 25305 - protein, 17 aa, Brucella spp.
QDIASYLMSINAVKGVE

SEQ ID NO: 25306 - protein, 24 aa, Brucella spp.
GNDGKPIFLSNHAGGVLGGIATGA

SEQ ID NO: 25307 - protein, 22 aa, Brucella spp.
FNKVTLFKPNLSRMEAKSAVTD

SEQ ID NO: 25308 - protein, 26 aa, Brucella spp.
TPGDALVTIRFKPHSRFRLEGRDVHV

SEQ ID NO: 25309 - protein, 23 aa, Brucella spp.
SSSDRVLRLKEKGLPLKAGGRGD

SEQ ID NO: 25310 - protein, 27 aa, Brucella spp.
GGRGDLYVHVRIMLPEGGDKELEDFLQ

SEQ ID NO: 25311 - protein, 45 aa, Brucella spp.
IGDIPRPPYWSGFRIRPVSIEFWHDRPFRLHDRVLFTRPTPEGDW

SEQ ID NO: 25312 - protein, 25 aa, Brucella spp.
GREHALAWKLAASPLLEKLYCALGN

SEQ ID NO: 25313 - protein, 24 aa, Brucella spp.
PFSGILFAGLMITSDGPKLIEYNT

SEQ ID NO: 25314 - protein, 27 aa, Brucella spp.
GDPECQVLMMRLNSDLLALVNAAVDGR

SEQ ID NO: 25315 - protein, 27 aa, Brucella spp.
ARAYEALKLIDWPEGFYRSDIGWRAVE

SEQ ID NO: 25316 - protein, 27 aa, Brucella spp.
SFGSEILDFLIPLAETKKPIVSGVDGL

SEQ ID NO: 25317 - protein, 25 aa, Brucella spp.
FATPRALFRTPFVDLGLVPEAGSSL

SEQ ID NO: 25318 - protein, 24 aa, Brucella spp.
SLLAPLLMGHQKAFALLALGHGFT

SEQ ID NO: 25319 - protein, 28 aa, Brucella spp.
LPVPGIRRFVMGAYLIDYEIRADAILIF

SEQ ID NO: 25320 - protein, 18 aa, Brucella spp.
EIRADAILIFAIRHGRER

SEQ ID NO: 25321 - protein, 20 aa, Brucella spp.
GNMRELCLGLEVVLPTGEIL

SEQ ID NO: 25322 - protein, 26 aa, Brucella spp.
DPLESPHDWYVLIDISSSRSEEDART

SEQ ID NO: 25323 - protein, 18 aa, Brucella spp.
ARWHDLNHRIHTIVASYG

SEQ ID NO: 25324 - protein, 35 aa, Brucella spp.
QLKREELVFFKQDIALDLMRRIKAAFDPAGIMNPG

SEQ ID NO: 25325 - protein, 25 aa, Brucella spp.
LVPQTIRNFPWPKSMRWGVASARPG

SEQ ID NO: 25326 - protein, 26 aa, Brucella spp.
SARPGALRWVRPLQSILCTFGPETEE

SEQ ID NO: 25327 - protein, 26 aa, Brucella spp.
ARLSDALYFWHTDQHDLPDLDKLAAS

SEQ ID NO: 25328 - protein, 40 aa, Brucella spp.
RRAALGVIRLLLSQEWKFPLLPLFRSAFAALQEGQMQRKL

SEQ ID NO: 25329 - protein, 20 aa, Brucella spp.
VLADLLSFFHDRFKVHLKEE

SEQ ID NO: 25330 - protein, 27 aa, Brucella spp.
EADNLLLVARRLEALIVFINEVDGKNL

SEQ ID NO: 25331 - protein, 24 aa, Brucella spp.
PVEKKWRIMREILEVLEAANHPVG

SEQ ID NO: 25332 - protein, 38 aa, Brucella spp.
AREAGYVLLPLEVAPLFKDWLLRNYPDRYRHVMSLVRS

SEQ ID NO: 25333 - protein, 21 aa, Brucella spp.
PLLFDLPLAPDFSQEQQLMKR

SEQ ID NO: 25334 - protein, 26 aa, Brucella spp.
AARREALYEIILTKAITVSVASLSAR

SEQ ID NO: 25335 - protein, 22 aa, Brucella spp.
IALVIFVAIVVYMKVPGMIGRT

SEQ ID NO: 25336 - protein, 36 aa, Brucella spp.
THYASQVLWLAITFGLFYLFLSRVVLPRIGGVIETR

SEQ ID NO: 25337 - protein, 44 aa, Brucella spp.
AGSKGMKFFPFVFSLFMFVLVANFIGLFPYFYTVTSQIIVTFAL

SEQ ID NO: 25338 - protein, 27 aa, Brucella spp.
PHKQHWLVPFVLAASAYLFNSNAIAFQ

SEQ ID NO: 25339 - protein, 28 aa, Brucella spp.
ATHYHATYVRPFWAPTMKKLTKIGLHIF

SEQ ID NO: 25340 - protein, 17 aa, Brucella spp.
ISADWEWHGRKIKLFDT

SEQ ID NO: 25341 - protein, 18 aa, Brucella spp.
WEWHGRKIKLFDTAGMRR

SEQ ID NO: 25342 - protein, 32 aa, Brucella spp.
ADSLRAIRFAEVVIIVLDATIPFEKQDLQIAD

SEQ ID NO: 25343 - protein, 27 aa, Brucella spp.
DAMPQSYVRYLINGLRETFDMPGVPIR

SEQ ID NO: 25344 - protein, 19 aa, Brucella spp.
NGLRETFDMPGVPIRLSLR

SEQ ID NO: 25345 - protein, 27 aa, Brucella spp.
RSERAKQVWRNFGPALIGAAVAVVLGT

SEQ ID NO: 25346 - protein, 18 aa, Brucella spp.
RQRANIMLDLMHSAGVAA

SEQ ID NO: 25347 - protein, 18 aa, Brucella spp.
LQHWLASWRDSLMACVAG

SEQ ID NO: 25348 - protein, 18 aa, Brucella spp.
VAELSLFLPQTVSVLHTG

SEQ ID NO: 25349 - protein, 25 aa, Brucella spp.
GAGVGLLFSQILLTPDPVRVIDRAV

SEQ ID NO: 25350 - protein, 22 aa, Brucella spp.
YERRGIRLYAAALLFGEALGNA

SEQ ID NO: 25351 - protein, 17 aa, Brucella spp.
DTLLHFLNSDQPDSVLV

SEQ ID NO: 25352 - protein, 24 aa, Brucella spp.
TMKKARIWLEDHGIDYAFHDYKKE

SEQ ID NO: 25353 - protein, 25 aa, Brucella spp.
DAETLDRFLKTVPWEQLLNRAGTTF

SEQ ID NO: 25354 - protein, 32 aa, Brucella spp.
RKDGNVRLVMKDWIIFGETSAYAARLVLAAEK

SEQ ID NO: 25355 - protein, 26 aa, Brucella spp.
DELFRTHMWILFATLAIFTILLMRNA

SEQ ID NO: 25356 - protein, 27 aa, Brucella spp.
LFGGDLAWFVFWGYQLFIVMAATGYLL

SEQ ID NO: 25357 - protein, 26 aa, Brucella spp.
EPEWYVDIWLTIVWVAYLVVFMGTLL

SEQ ID NO: 25358 - protein, 25 aa, Brucella spp.
IYVANWFYLSFIITIAMLHIINNLA

SEQ ID NO: 25359 - protein, 22 aa, Brucella spp.
NAVAFFLTVPFLAMMYYFVPKQ

SEQ ID NO: 25360 - protein, 31 aa, Brucella spp.
YSYRLSIVHFWSIIFLYIWAGPHHLHYTAVP

SEQ ID NO: 25361 - protein, 24 aa, Brucella spp.
IRMVNWHFWLATLGIVLYASSMWV

SEQ ID NO: 25362 - protein, 17 aa, Brucella spp.
LEKNATLLLIASLAVVT

SEQ ID NO: 25363 - protein, 24 aa, Brucella spp.
LVEIAPLFYLENTIEKVEGMRPYS

SEQ ID NO: 25364 - protein, 27 aa, Brucella spp.
MISEMDALIAYLQMLGTLVDFSTYDQS

SEQ ID NO: 25365 - protein, 38 aa, Brucella spp.
KELDNPMPRWWLWTFYATIFWAIAYVIAYPAWPLISGS

SEQ ID NO: 25366 - protein, 29 aa, Brucella spp.
GTFRRFKWIVMFITLGIYYLTPWLRWDRG

SEQ ID NO: 25367 - protein, 33 aa, Brucella spp.
IDLANRRFYFFFIEIWPQEFYYVAGLLIMAGLG

SEQ ID NO: 25368 - protein, 17 aa, Brucella spp.
TGGAWIFYFADAPTLLK

SEQ ID NO: 25369 - protein, 18 aa, Brucella spp.
IFYFADAPTLLKDFVTGH

SEQ ID NO: 25370 - protein, 26 aa, Brucella spp.
LRPRSMFYFAIWALIGVVLIVSLSTR

SEQ ID NO: 25371 - protein, 32 aa, Brucella spp.
GTFTGWHMLGIMFMFFGVIIAVNLLMAYNAIH

SEQ ID NO: 25372 - protein, 30 aa, Brucella spp.
RDEALKIIERYRLDLPQAALAHIKSENAHA

SEQ ID NO: 25373 - protein, 27 aa, Brucella spp.
KGGRNSEFLLSFALDIDGYANIHALAA

SEQ ID NO: 25374 - protein, 17 aa, Brucella spp.
TAFDALGDLFVPGPTGT

SEQ ID NO: 25375 - protein, 20 aa, Brucella spp.
ADHRPHLVVPGFIDTHIHYP

SEQ ID NO: 25376 - protein, 25 aa, Brucella spp.
SYAANLLEWLNTYTFVAEQKFADEQ

SEQ ID NO: 25377 - protein, 20 aa, Brucella spp.
GRLDYVITPRFAITSTPEQL

SEQ ID NO: 25378 - protein, 18 aa, Brucella spp.
FCPTSNLFLGSGLFDRDR

SEQ ID NO: 25379 - protein, 31 aa, Brucella spp.
QLRGQRLNPFQSFYMMTLGNARALSMEDRIG

SEQ ID NO: 25380 - protein, 24 aa, Brucella spp.
ATLEQELFLLQTLGDDRAIVETYV

SEQ ID NO: 25381 - protein, 24 aa, Brucella spp.
AVDKVEFHGQPIFAVIAKTRDQAR

SEQ ID NO: 25382 - protein, 35 aa, Brucella spp.
AAPHRIRNRMYLGGQDHFYLEGQVSLAVPGEDEDV

SEQ ID NO: 25383 - protein, 26 aa, Brucella spp.
DGTILGVDYLYALNAGFSADLSGPVG

SEQ ID NO: 25384 - protein, 32 aa, Brucella spp.
PVGDRALFHCDNAYFYPAVHAQSAPLYTNTVS

SEQ ID NO: 25385 - protein, 20 aa, Brucella spp.
RYVKRGIALTPVKFGISFTK

SEQ ID NO: 25386 - protein, 26 aa, Brucella spp.
ARQIKKRLIRFAAQQYQVPEDQIMFL

SEQ ID NO: 25387 - protein, 27 aa, Brucella spp.
YQVPEDQIMFLPNRVRVGNQEISFNDL

SEQ ID NO: 25388 - protein, 24 aa, Brucella spp.
KGRGHAFYYYAYGAACSEVSVDTL

SEQ ID NO: 25389 - protein, 30 aa, Brucella spp.
FSDIVTSFLPFWEKTRLWVIARPLSGFAET

SEQ ID NO: 25390 - protein, 24 aa, Brucella spp.
VEAGDFMWLRAFCPQACYAGGPGK

SEQ ID NO: 25391 - protein, 18 aa, Brucella spp.
VLLVDNHPLVLDGLRAVL

SEQ ID NO: 25392 - protein, 29 aa, Brucella spp.
AVNPDVVLMDINMPLLNGIDAIELFKRQL

SEQ ID NO: 25393 - protein, 34 aa, Brucella spp.
GIDAIELFKRQLPNVRILMLSMHDSREYISTSIM

SEQ ID NO: 25394 - protein, 25 aa, Brucella spp.
LKPGKHLWLLSTGTGLAPFLSIIRD

SEQ ID NO: 25395 - protein, 21 aa, Brucella spp.
EMVKNQLIYYPTVTREPYKNR

SEQ ID NO: 25396 - protein, 17 aa, Brucella spp.
IYYPTVTREPYKNRGRL

SEQ ID NO: 25397 - protein, 25 aa, Brucella spp.
ARLLDPHCDLLLVGDSLGMVLYGME

SEQ ID NO: 25398 - protein, 22 aa, Brucella spp.
AVTLDMMIMHGQAVMRGTSHAC

SEQ ID NO: 25399 - protein, 25 aa, Brucella spp.
MAETVAFLVRRGIPVFGHVGLMPQQ

SEQ ID NO: 25400 - protein, 29 aa, Brucella spp.
VSDDMLGLFQDFTPRFVKRFAHLAPQVSQ

SEQ ID NO: 25401 - protein, 18 aa, Brucella spp.
IGFVPTMGYLHKGHLELV

SEQ ID NO: 25402 - protein, 19 aa, Brucella spp.
LHDAQVDYLFAPTVSDMYP

SEQ ID NO: 25403 - protein, 26 aa, Brucella spp.
KDFQQLVIIRRMVDDMAIPVRIVGVE

SEQ ID NO: 25404 - protein, 26 aa, Brucella spp.
LQGRPILVALFVRVGATRLLDNRVIG

SEQ ID NO: 25405 - protein, 20 aa, Brucella spp.
PFVATLFWSAATILLYLAAK

SEQ ID NO: 25406 - protein, 29 aa, Brucella spp.
AKRVYRRFPLWWLTPLAVTPLLLMALVIG

SEQ ID NO: 25407 - protein, 32 aa, Brucella spp.
MKRGAEWFLAEMLLFFIPAVLAILEHRELIGM

SEQ ID NO: 25408 - protein, 22 aa, Brucella spp.
IGSSVLFAPVFAAYTSLYPDID

SEQ ID NO: 25409 - protein, 28 aa, Brucella spp.
LREIANLPFILFESGFALNHIILSACQR

SEQ ID NO: 25410 - protein, 23 aa, Brucella spp.
DVNWRMAFVWRKGAFLSHAARAW

SEQ ID NO: 25411 - protein, 17 aa, Brucella spp.
KRRLHTPRYPFALSRNE

SEQ ID NO: 25412 - protein, 26 aa, Brucella spp.
FRDEAVRIIIPNPIGLGMVAQFVSYD

SEQ ID NO: 25413 - protein, 24 aa, Brucella spp.
VDTTVQMRWVTGLQPLSVIPGGVK

SEQ ID NO: 25414 - protein, 19 aa, Brucella spp.
FADLERIVGRFPQAIWRNN

SEQ ID NO: 25415 - protein, 23 aa, Brucella spp.
STIARLLPNCLILSDELNHASMI

SEQ ID NO: 25416 - protein, 26 aa, Brucella spp.
VRSYAPGFIFTTSLPPAVAAAATAAI

SEQ ID NO: 25417 - protein, 21 aa, Brucella spp.
VMPSQTHIVPILVGDPELCKK

SEQ ID NO: 25418 - protein, 18 aa, Brucella spp.
HIVPILVGDPELCKKASD

SEQ ID NO: 25419 - protein, 30 aa, Brucella spp.
KASDRLLEVHGIYIQPINYPTVPRGTERLR

SEQ ID NO: 25420 - protein, 24 aa, Brucella spp.
LKDALLEVWNELGIPFAEPSAPQA

SEQ ID NO: 25421 - protein, 31 aa, Brucella spp.
YGNFITLLINFLIIAWVLFLVVKLMNRLKKR

SEQ ID NO: 25422 - protein, 28 aa, Brucella spp.
ELVLRGIFMVRRFEVDWMYSNGASIIFP

SEQ ID NO: 25423 - protein, 27 aa, Brucella spp.
GRYDICTPFINAWQLKKMWPEADLKIV

SEQ ID NO: 25424 - protein, 27 aa, Brucella spp.
VSRGGALFPHLYAPLPLTAVVKVEPLP

SEQ ID NO: 25425 - protein, 22 aa, Brucella spp.
PTAIFNAIRKANGLPLMATDSR

SEQ ID NO: 25426 - protein, 28 aa, Brucella spp.
GHRKNMLDPTFAHYGLAWATPESNPRRI

SEQ ID NO: 25427 - protein, 35 aa, Brucella spp.
SAFYWTPYDILYGIRDFFLHLWNMGFSAVARFADY

SEQ ID NO: 25428 - protein, 27 aa, Brucella spp.
VLETGCVYIVPLLESLALSPELSASAN

SEQ ID NO: 25429 - protein, 25 aa, Brucella spp.
AGYKGPLYLEVSPRTFPIVVRTGSR

SEQ ID NO: 25430 - protein, 21 aa, Brucella spp.
AHDVLDFWEPLYDRGAHELVL

SEQ ID NO: 25431 - protein, 26 aa, Brucella spp.
ELVLDPDEFYILVSREAVHVPPLYAA

SEQ ID NO: 25432 - protein, 18 aa, Brucella spp.
SHEVPFILEHGQIVGRLV

SEQ ID NO: 25433 - protein, 17 aa, Brucella spp.
VPFILEHGQIVGRLVYE

SEQ ID NO: 25434 - protein, 18 aa, Brucella spp.
FILEHGQIVGRLVYEHML

SEQ ID NO: 25435 - protein, 23 aa, Brucella spp.
IVGRLVYEHMLGQPKALYGIDLG

SEQ ID NO: 25436 - protein, 25 aa, Brucella spp.
EPEENRYVWGYRVTIVNNSSETVQL

SEQ ID NO: 25437 - protein, 24 aa, Brucella spp.
EDGAQFEIEIPAFSLDVPEQRRTL

SEQ ID NO: 25438 - protein, 25 aa, Brucella spp.
LLAEATVLTVLLGTSLKFDGKFIFQ

SEQ ID NO: 25439 - protein, 19 aa, Brucella spp.
FDGKFIFQTQSDGPVDMLV

SEQ ID NO: 25440 - protein, 17 aa, Brucella spp.
DGKPVEQWRAGGLIIQF

SEQ ID NO: 25441 - protein, 30 aa, Brucella spp.
PVEQWRAGGLIIQFLPESELRVRVPDLPGG

SEQ ID NO: 25442 - protein, 27 aa, Brucella spp.
VGSERLLYRLFHERGVRVFDSIAVIDE

SEQ ID NO: 25443 - protein, 19 aa, Brucella spp.
HFIDLSTVPATELRAILED

SEQ ID NO: 25444 - protein, 25 aa, Brucella spp.
YAGKVLAMIFEKLSTRTRVSFDVGM

SEQ ID NO: 25445 - protein, 26 aa, Brucella spp.
HARGHNVFIPYQVNANLMAKADPKAL

SEQ ID NO: 25446 - protein, 23 aa, Brucella spp.
ADPKALFMHCLPAHRGEEVTDEV

SEQ ID NO: 25447 - protein, 19 aa, Brucella spp.
RLHAQKAILAWCLQDRGLG

SEQ ID NO: 25448 - protein, 27 aa, Brucella spp.
VSGHPERFRIITFEGAFHGRTLATIAA

SEQ ID NO: 25449 - protein, 28 aa, Brucella spp.
RAFPEEFLRLVRQICDENGLLLLLDEVQ

SEQ ID NO: 25450 - protein, 22 aa, Brucella spp.
ENGLLLLLDEVQTGVGRTGKLF

SEQ ID NO: 25451 - protein, 17 aa, Brucella spp.
FAHEWAGIRPDIMAIAK

SEQ ID NO: 25452 - protein, 25 aa, Brucella spp.
GAGDNVVRLLPPLITTPEEAREALK

SEQ ID NO: 25453 - protein, 28 aa, Brucella spp.
GVTRGAIYFHFEDKLDIFQSIIGRARFP

SEQ ID NO: 25454 - protein, 23 aa, Brucella spp.
EMRSNVLALFIGLLKVAERRGEL

SEQ ID NO: 25455 - protein, 32 aa, Brucella spp.
VKGDRVAIMMPNILQYPITFTAVLRAGFVVVN

SEQ ID NO: 25456 - protein, 31 aa, Brucella spp.
PKALNFVCALPLYHIFALTVNAMIGMKLGAR

SEQ ID NO: 25457 - protein, 27 aa, Brucella spp.
KELKKYPVHIFPGLNTLFNGLINNPDF

SEQ ID NO: 25458 - protein, 20 aa, Brucella spp.
DFQTLDFKPLILTLGGGMAV

SEQ ID NO: 25459 - protein, 17 aa, Brucella spp.
DMILVSGFNVYPNEIEE

SEQ ID NO: 25460 - protein, 31 aa, Brucella spp.
DKDGTLIDFDRTWFSISWQLAQWSAQGDEVL

SEQ ID NO: 25461 - protein, 20 aa, Brucella spp.
EDIVSLWHPGLAGPQLRSLI

SEQ ID NO: 25462 - protein, 26 aa, Brucella spp.
PKPFPDPLLYFAEKLGLSPHEIAMVG

SEQ ID NO: 25463 - protein, 26 aa, Brucella spp.
LPGQAALHFLIPMLKQAAEEGRILGN

SEQ ID NO: 25464 - protein, 30 aa, Brucella spp.
HLGRFETFSLINFNRAFPLLPDFDTSDLPG

SEQ ID NO: 25465 - protein, 19 aa, Brucella spp.
FGRYSLCLDDLLFDWSKCR

SEQ ID NO: 25466 - protein, 38 aa, Brucella spp.
GIPEDRVFGFWDWVGGRYSVWSAIGLPVMIAVGPDNFR

SEQ ID NO: 25467 - protein, 29 aa, Brucella spp.
APLEKNLPVMLGLIGYWHRAICGYGSRAI

SEQ ID NO: 25468 - protein, 24 aa, Brucella spp.
NGQHAFFQLLHQGTDTIPLEFIVA

SEQ ID NO: 25469 - protein, 26 aa, Brucella spp.
NRPSLTLIHDMLDPYTLGRLIALYEH

SEQ ID NO: 25470 - protein, 23 aa, Brucella spp.
GRLIALYEHRVFVEAQIFGINAF

SEQ ID NO: 25471 - protein, 19 aa, Brucella spp.
RVFVEAQIFGINAFDQWGV

SEQ ID NO: 25472 - protein, 30 aa, Brucella spp.
MNACPTGIDIPLFIRQINAGNPAGAARTIL

SEQ ID NO: 25473 - protein, 27 aa, Brucella spp.
NFAQRELDFVLQIGGIHIEYNQTLGQD

SEQ ID NO: 25474 - protein, 24 aa, Brucella spp.
KAGYDAVFLAMGLPGVNDLGLAGE

SEQ ID NO: 25475 - protein, 28 aa, Brucella spp.
LAQIHGVVIRHWLQPHALERSEDGIVHA

SEQ ID NO: 25476 - protein, 26 aa, Brucella spp.
LGIKSPNPFWLASAPPTDKAYNVERA

SEQ ID NO: 25477 - protein, 26 aa, Brucella spp.
EMKEVKMRWPDRALIASIMVPCEEEA

SEQ ID NO: 25478 - protein, 26 aa, Brucella spp.
VSHVTDWQYLNLNYVTKARINQDLCI

SEQ ID NO: 25479 - protein, 28 aa, Brucella spp.
IAPVDPYHLIFTIWAVTQHYSDFAVQVL

SEQ ID NO: 25480 - protein, 26 aa, Brucella spp.
GSRKIHAMFELHIEQGPILEAEHKDI

SEQ ID NO: 25481 - protein, 28 aa, Brucella spp.
GVVTHGQGLWWLQVTLTGKEAHTGSTPM

SEQ ID NO: 25482 - protein, 26 aa, Brucella spp.
GIDPHTHLQMPFMGTYSSDDFDTGTA

SEQ ID NO: 25483 - protein, 24 aa, Brucella spp.
KARTDYSFHIAITGWNERTFNEMV

SEQ ID NO: 25484 - protein, 27 aa, Brucella spp.
VKRGINTFKHFMAYKGALMVNDDEMFA

SEQ ID NO: 25485 - protein, 24 aa, Brucella spp.
ATNRAIMIADQAGVPLYVVHVSCE

SEQ ID NO: 25486 - protein, 17 aa, Brucella spp.
RVFGEPLIQHLTLDESE

SEQ ID NO: 25487 - protein, 23 aa, Brucella spp.
EERMPVLWTRGVRTGRLTPNEFV

SEQ ID NO: 25488 - protein, 23 aa, Brucella spp.
ADADLVIWDPEATKKISAKTQHS

SEQ ID NO: 25489 - protein, 31 aa, Brucella spp.
SIDYNVFEGFELKGLPIMTLSRGRIAFDKGQ

SEQ ID NO: 25490 - protein, 22 aa, Brucella spp.
LCLLIILAATGGWYVYKNNNGA

SEQ ID NO: 25491 - protein, 28 aa, Brucella spp.
IDDRSTVLIDIWVPERFAPQIKVGQPLT

SEQ ID NO: 25492 - protein, 25 aa, Brucella spp.
RAGMSFSVTILFPGDNYPSVDPLAI

SEQ ID NO: 25493 - protein, 25 aa, Brucella spp.
ADYRKKRLAEQLRANLMRRKAQSRS

SEQ ID NO: 25494 - protein, 25 aa, Brucella spp.
KNAALPLMIASLLTDDTLTLENVPH

SEQ ID NO: 25495 - protein, 28 aa, Brucella spp.
ELVSRMRASFWVIGPLLARMGEANVSLP

SEQ ID NO: 25496 - protein, 26 aa, Brucella spp.
IGTRPVDLLLDALLALGAEIDIENGY

SEQ ID NO: 25497 - protein, 23 aa, Brucella spp.
VGATHVMLMAATLAKGETIIENA

SEQ ID NO: 25498 - protein, 21 aa, Brucella spp.
TIFENRFMHVQELARLGAKIS

SEQ ID NO: 25499 - protein, 26 aa, Brucella spp.
VAGVDRIVMVVPAPDGNLNPLVLVAA

SEQ ID NO: 25500 - protein, 22 aa, Brucella spp.
GNLNPLVLVAARLAGVSEIYRV

SEQ ID NO: 25501 - protein, 25 aa, Brucella spp.
VAAAKRIVFGTVGIDMIAGPSEVLI

SEQ ID NO: 25502 - protein, 20 aa, Brucella spp.
WRDFGAVILVKDFEDAIPLA

SEQ ID NO: 25503 - protein, 25 aa, Brucella spp.
ADAEAFVPRIRNAGSIFIGGYTPEV

SEQ ID NO: 25504 - protein, 17 aa, Brucella spp.
LSVLDYMKRTSLLKLGS

SEQ ID NO: 25505 - protein, 18 aa, Brucella spp.
LDYMKRTSLLKLGSEQLR

SEQ ID NO: 25506 - protein, 25 aa, Brucella spp.
AAPGKFWHHLTGDSQLRWIGPEKGA

SEQ ID NO: 25507 - protein, 27 aa, Brucella spp.
EVDQAIEWVRRLAFANPFFIEEPTSPD

SEQ ID NO: 25508 - protein, 24 aa, Brucella spp.
MCQNRIMFKQFIAEGAIDVVQIDS

SEQ ID NO: 25509 - protein, 26 aa, Brucella spp.
VAEIGQIDILFNCAGFVHNGTILEMK

SEQ ID NO: 25510 - protein, 26 aa, Brucella spp.
NLNVRSMIRTIRAVLPGMLERKDGAI

SEQ ID NO: 25511 - protein, 24 aa, Brucella spp.
GVSNRFVYGLTKAAVIGLTKAVAA

SEQ ID NO: 25512 - protein, 21 aa, Brucella spp.
ALRQWWARPSRPKPIVIFGAG

SEQ ID NO: 25513 - protein, 26 aa, Brucella spp.
KAAVNFQLRFAPMMLALYDAVDKGWL

SEQ ID NO: 25514 - protein, 36 aa, Brucella spp.
EVVDFDAWLALATPWGLWPFLKGLPRIEIAMHSIHY

SEQ ID NO: 25515 - protein, 24 aa, Brucella spp.
IAMHSIHYLDFVRGLLGNPQGVHA

SEQ ID NO: 25516 - protein, 24 aa, Brucella spp.
GGSSVMRLLADHLAPLVIGEDADC

SEQ ID NO: 25517 - protein, 25 aa, Brucella spp.
ADCIEAIWRRLEFATHATTIGAITA

SEQ ID NO: 25518 - protein, 29 aa, Brucella spp.
EAFDIPVCPHFLMELHVSLVCAVPNGRYV

SEQ ID NO: 25519 - protein, 20 aa, Brucella spp.
LIDKNALSYPWLESAPALNR

SEQ ID NO: 25520 - protein, 19 aa, Brucella spp.
ALSYPWLESAPALNRDFLF

SEQ ID NO: 25521 - protein, 24 aa, Brucella spp.
PALNRDFLFDSYRLQAERAGIGGA

SEQ ID NO: 25522 - protein, 26 aa, Brucella spp.
IQSFGWDRVIWGSDWPVCTLASSPDA

SEQ ID NO: 25523 - protein, 27 aa, Brucella spp.
EEVETPAFWMTFKCAVMNLPYGGGKGA

SEQ ID NO: 25524 - protein, 20 aa, Brucella spp.
VYTNSMIMGWMADEYSQIVG

SEQ ID NO: 25525 - protein, 22 aa, Brucella spp.
RGGFYLVRHLSHDLGLASVLRV

SEQ ID NO: 25526 - protein, 26 aa, Brucella spp.
GVTVSYFEWVQNRQGYYWTLEEIHER

SEQ ID NO: 25527 - protein, 17 aa, Brucella spp.
AGEIDIYPEYTGNAAFF

SEQ ID NO: 25528 - protein, 19 aa, Brucella spp.
EIDIYPEYTGNAAFFFNKA

SEQ ID NO: 25529 - protein, 26 aa, Brucella spp.
PEYTGNAAFFFNKADDPLWKDPAKAY

SEQ ID NO: 25530 - protein, 26 aa, Brucella spp.
DYDANKIVWLTPSPANNTWGIAVRKD

SEQ ID NO: 25531 - protein, 39 aa, Brucella spp.
FRILFTTHPTPMWVYDPETLRFIVMNDAAYELYGYTADE

SEQ ID NO: 25532 - protein, 26 aa, Brucella spp.
GSDCDPFALFYLDIDHFKNVNDSISH

SEQ ID NO: 25533 - protein, 23 aa, Brucella spp.
AAGQFQLHYQPIFNLEGGHISGF

SEQ ID NO: 25534 - protein, 23 aa, Brucella spp.
HNIELLFDLRRLGVRIAMDDFGT

SEQ ID NO: 25535 - protein, 25 aa, Brucella spp.
GDSSLSYLRAFPFDKIKIDRSFVSG

SEQ ID NO: 25536 - protein, 25 aa, Brucella spp.
LPLPHCKPLIQLILQDNTDPSHEAD

SEQ ID NO: 25537 - protein, 33 aa, Brucella spp.
INLSRPVRLLHPRIPLYIVPRGDGIHMIGATMI

SEQ ID NO: 25538 - protein, 25 aa, Brucella spp.
YVNGLYRHGFLLSPAVARMAVAVAT

SEQ ID NO: 25539 - protein, 18 aa, Brucella spp.
FESRLLLGTAQYPSPSIL

SEQ ID NO: 25540 - protein, 26 aa, Brucella spp.
ARAGQDFWALIKALGVAVLPNTAGCH

SEQ ID NO: 25541 - protein, 24 aa, Brucella spp.
CDEGFEVFPYMNDDLIVAERLIEA

SEQ ID NO: 25542 - protein, 23 aa, Brucella spp.
YALKTMRAHFPDIPLVVDAGIGV

SEQ ID NO: 25543 - protein, 33 aa, Brucella spp.
TLPKAAFLHYLRQDYVYLHHYARAFALGVVKAN

SEQ ID NO: 25544 - protein, 19 aa, Brucella spp.
PRWPKLCQIFATASRLEAD

SEQ ID NO: 25545 - protein, 32 aa, Brucella spp.
LWANAPHIIHPMRFVLPYHKGGLRPAWLLRLG

SEQ ID NO: 25546 - protein, 29 aa, Brucella spp.
HKGGLRPAWLLRLGLFLYDHLGGRKKLPA

SEQ ID NO: 25547 - protein, 19 aa, Brucella spp.
SDPRAYFFQNNDGRIIFAI

SEQ ID NO: 25548 - protein, 28 aa, Brucella spp.
YFFQNNDGRIIFAIPYEDDFTLIGTTDQ

SEQ ID NO: 25549 - protein, 25 aa, Brucella spp.
FLDARRLFRLYGTRAYKLLGQASSL

SEQ ID NO: 25550 - protein, 18 aa, Brucella spp.
SAEDILWRRTKLGLRLTA

SEQ ID NO: 25551 - protein, 18 aa, Brucella spp.
ILWRRTKLGLRLTAAEVA

SEQ ID NO: 25552 - protein, 25 aa, Brucella spp.
DLCRARLLRRIHGGALYPSGVENME

SEQ ID NO: 25553 - protein, 27 aa, Brucella spp.
VGEAAVDFIRQFKVDFAIIGTSAIDED

SEQ ID NO: 25554 - protein, 17 aa, Brucella spp.
GALLDFDFREVKVAQAI

SEQ ID NO: 25555 - protein, 20 aa, Brucella spp.
LLDFDFREVKVAQAIIANAR

SEQ ID NO: 25556 - protein, 26 aa, Brucella spp.
NLERECIFNGLVMNGLKLAVICRPFI

SEQ ID NO: 25557 - protein, 31 aa, Brucella spp.
SGEMQAIIDKWRPVPVVFLAEREEWAQVVRA

SEQ ID NO: 25558 - protein, 26 aa, Brucella spp.
PDHLGRKFLLVDPLDGTREFLLRNGD

SEQ ID NO: 25559 - protein, 23 aa, Brucella spp.
DGTREFLLRNGDFTVNIGLVEEG

SEQ ID NO: 25560 - protein, 33 aa, Brucella spp.
EGAPVLGIVYAPARNLLFIGSDAGAWAMETTPD

SEQ ID NO: 25561 - protein, 27 aa, Brucella spp.
DGKSTLIGRLLYDTKLIFEDQLASLKN

SEQ ID NO: 25562 - protein, 26 aa, Brucella spp.
GITIDVAYRFFSTPRRKFIVADTPGH

SEQ ID NO: 25563 - protein, 18 aa, Brucella spp.
ASSPRIGWYEGPHLLEHL

SEQ ID NO: 25564 - protein, 18 aa, Brucella spp.
RIGWYEGPHLLEHLETVR

SEQ ID NO: 25565 - protein, 25 aa, Brucella spp.
EAAAKPFRFPVQYVNRPNLDFRGFS

SEQ ID NO: 25566 - protein, 27 aa, Brucella spp.
ADRFAADIVWFGEDPLLPGRSYLLRTE

SEQ ID NO: 25567 - protein, 25 aa, Brucella spp.
QKFQKPAVLWFTGLSASGKSTIANR

SEQ ID NO: 25568 - protein, 24 aa, Brucella spp.
PEGEFIEIFIDTPIEECMARDPKG

SEQ ID NO: 25569 - protein, 34 aa, Brucella spp.
MLHLAMKAFYPAPPPFPFLHVDTTWKFREMIEFR

SEQ ID NO: 25570 - protein, 30 aa, Brucella spp.
NWTELDIWQYILQENIPIVPLYFAARRPVV

SEQ ID NO: 25571 - protein, 26 aa, Brucella spp.
IDGGSDIILIETIFDTLNAKAAVFAT

SEQ ID NO: 25572 - protein, 27 aa, Brucella spp.
SGQTPTAFWYSLRHARPFTIGLNCALG

SEQ ID NO: 25573 - protein, 26 aa, Brucella spp.
KPAKVPPLMRLSGLEPFTLTKDIPFV

SEQ ID NO: 25574 - protein, 25 aa, Brucella spp.
DSEKAMVEFLNLIAAEPDIARVPIM

SEQ ID NO: 25575 - protein, 18 aa, Brucella spp.
FLHHARLVRAYGAAVVIM

SEQ ID NO: 25576 - protein, 26 aa, Brucella spp.
VGFPPEDIIFDPNIFAVATGIEEHNN

SEQ ID NO: 25577 - protein, 25 aa, Brucella spp.
REAMHAVFLYHAIQAGMDMGIVNAG

SEQ ID NO: 25578 - protein, 23 aa, Brucella spp.
FGSGKMFLPQVVKSARVMKQAVA

SEQ ID NO: 25579 - protein, 17 aa, Brucella spp.
MKQAVAVLLPFMEEEKR

SEQ ID NO: 25580 - protein, 22 aa, Brucella spp.
MEREGFDIPLLIGGATTSRVHT

SEQ ID NO: 25581 - protein, 34 aa, Brucella spp.
YDLAEIARYIDWTPFFQTWELRGRYPAILEDEKQ

SEQ ID NO: 25582 - protein, 26 aa, Brucella spp.
RKIIDEKWFTPRAVVGFWPANAVGDD

SEQ ID NO: 25583 - protein, 24 aa, Brucella spp.
HTEKTTLFRLLDATANTGVELTES

SEQ ID NO: 25584 - protein, 25 aa, Brucella spp.
DVEAVERWLTPILNYVPGASKDEAA

SEQ ID NO: 25585 - protein, 27 aa, Brucella spp.
HPRYRPYYRYYRHWGPPPRAYRGGNPH

SEQ ID NO: 25586 - protein, 24 aa, Brucella spp.
DLNRRVYEIILELKPGETTTYGAI

SEQ ID NO: 25587 - protein, 27 aa, Brucella spp.
YALGKNPFPIIVPCHRVLGSNGKVGGF

SEQ ID NO: 25588 - protein, 24 aa, Brucella spp.
GDAPAIVLPLAVWLELGEEHRRSS

SEQ ID NO: 25589 - protein, 25 aa, Brucella spp.
LGHLDSIALIALQFPVFNDGRSYSK

SEQ ID NO: 25590 - protein, 18 aa, Brucella spp.
LIDQAVLMLRAGFDTLQV

SEQ ID NO: 25591 - protein, 21 aa, Brucella spp.
TPVLFLDTGKHFRATLDYRHQ

SEQ ID NO: 25592 - protein, 23 aa, Brucella spp.
FRATLDYRHQLVGRLGLADVRDI

SEQ ID NO: 25593 - protein, 18 aa, Brucella spp.
FIRKVEPMARAVAPYRAW

SEQ ID NO: 25594 - protein, 40 aa, Brucella spp.
LTEDQFKPLRLMNGLYLQLHAYMLRVAIPYGTLSSRQLRK

SEQ ID NO: 25595 - protein, 24 aa, Brucella spp.
SLHPEFSYLPRKFKIAIVGSEHDR

SEQ ID NO: 25596 - protein, 30 aa, Brucella spp.
MVAKKIRDFLPIEDMLTYVTAIVRVYNLHG

SEQ ID NO: 25597 - protein, 18 aa, Brucella spp.
VIESYFRMPDLPQRPEGW

SEQ ID NO: 25598 - protein, 31 aa, Brucella spp.
MPVSLSQTRLLADFPAFFRVSGEVVAVVGGG

SEQ ID NO: 25599 - protein, 25 aa, Brucella spp.
VVDRPALCDFLTPAIVNRAPVTIAI

SEQ ID NO: 25600 - protein, 26 aa, Brucella spp.
KGLARRGFWRTFFSGKVARAVESGDH

SEQ ID NO: 25601 - protein, 23 aa, Brucella spp.
ADMELPLTLRGVASSLVFTTGHD

SEQ ID NO: 25602 - protein, 17 aa, Brucella spp.
RSNKRMFHGTLKDLPQL

SEQ ID NO: 25603 - protein, 17 aa, Brucella spp.
MFHGTLKDLPQLENRKE

SEQ ID NO: 25604 - protein, 24 aa, Brucella spp.
TMRARPLEPALYIVSTPIGNLGDM

SEQ ID NO: 25605 - protein, 22 aa, Brucella spp.
RVTRVLLDRYGISRRPISYHEH

SEQ ID NO: 25606 - protein, 26 aa, Brucella spp.
SGLPTDAFMFCGFLPAKHGQKQSRLE

SEQ ID NO: 25607 - protein, 17 aa, Brucella spp.
IRGEVVLLVGPPTGEAV

SEQ ID NO: 25608 - protein, 23 aa, Brucella spp.
EEDIDRLLLSLVAEMPPSKAAGE

SEQ ID NO: 25609 - protein, 22 aa, Brucella spp.
AGKLREFDGLIGPFGFEVSSVA

SEQ ID NO: 25610 - protein, 24 aa, Brucella spp.
DKRKARFVSVICLAWPDGEAEYFR

SEQ ID NO: 25611 - protein, 26 aa, Brucella spp.
GEVEGTLVWPPRGNIGFGYDPVFLPD

SEQ ID NO: 25612 - protein, 22 aa, Brucella spp.
IGFGYDPVFLPDGYGKTFGEMT

SEQ ID NO: 25613 - protein, 17 aa, Brucella spp.
EEKVPGWMRNTGKGWVT

SEQ ID NO: 25614 - protein, 27 aa, Brucella spp.
GGWVALHECLRWMEARQMVRVEKVLKD

SEQ ID NO: 25615 - protein, 25 aa, Brucella spp.
DQRSRDIFRLIVETYLNDGDPVGSR

SEQ ID NO: 25616 - protein, 28 aa, Brucella spp.
GRLPTQIGLRFFVDAFLEVGDLPPEERS

SEQ ID NO: 25617 - protein, 27 aa, Brucella spp.
ALKHIEFVRLEPMRALAVLVMQNGDVE

SEQ ID NO: 25618 - protein, 19 aa, Brucella spp.
YAITNFARDMLSVSDNLRR

SEQ ID NO: 25619 - protein, 26 aa, Brucella spp.
GVEMTERAMLLALERHGVKKLEPEGQ

SEQ ID NO: 25620 - protein, 27 aa, Brucella spp.
QKFDPNFHQAMFEVPNPDLPNNTVVQV

SEQ ID NO: 25621 - protein, 32 aa, Brucella spp.
LVRVIPREYMLHAHHWLILHGRYVCKARKPEC

SEQ ID NO: 25622 - protein, 46 aa, Brucella spp.
LTGCWMFVGILFWSIGAWPIFGFFGLDVLLIYLAFRWNYHAARARE

SEQ ID NO: 25623 - protein, 27 aa, Brucella spp.
GIAARQFQRVFVLADGMRVLACELRNG

SEQ ID NO: 25624 - protein, 26 aa, Brucella spp.
PPIAPGLELWALFGASGEPIVLSDVR

SEQ ID NO: 25625 - protein, 28 aa, Brucella spp.
ALDDQPVDLVFLLLAPENAGADHLKALS

SEQ ID NO: 25626 - protein, 17 aa, Brucella spp.
IYDDVAYRVMAPLPEEE

SEQ ID NO: 25627 - protein, 24 aa, Brucella spp.
ASAVVELDLTEHPVLVFRNAGNDE

SEQ ID NO: 25628 - protein, 24 aa, Brucella spp.
NDEVNIVYRRADGNIGWVDPSTVT

SEQ ID NO: 25629 - protein, 37 aa, Brucella spp.
RQSQSLVMTPQLMQSIKLLQMTHIELDQFLDMEIEKN

SEQ ID NO: 25630 - protein, 24 aa, Brucella spp.
LDESGYLRIDIVGLAHNLGIETAE

SEQ ID NO: 25631 - protein, 21 aa, Brucella spp.
PATMPRLIVNNEYYAEVSGSV

SEQ ID NO: 25632 - protein, 30 aa, Brucella spp.
FMATPRGVFELRYFFTASLASSEGGEAHSS

SEQ ID NO: 25633 - protein, 30 aa, Brucella spp.
AAIALAAVFSWYTFLATPASPVKVEVNTGG

SEQ ID NO: 25634 - protein, 25 aa, Brucella spp.
KDNGKVLIFEYNVHMTVDGNTLSAN

SEQ ID NO: 25635 - protein, 32 aa, Brucella spp.
RLRRKLTSWRLAFLVLLAALIAGFAFYSLRSA

SEQ ID NO: 25636 - protein, 17 aa, Brucella spp.
EEAKNMIRSMIMDSYDW

SEQ ID NO: 25637 - protein, 25 aa, Brucella spp.
AKNMIRSMIMDSYDWFVGIVQERRA

SEQ ID NO: 25638 - protein, 23 aa, Brucella spp.
EIARDRIFLDGLLSVWHVDGIAG

SEQ ID NO: 25639 - protein, 23 aa, Brucella spp.
VEEKWVPFFKTGKKLRDRLNGAV

SEQ ID NO: 25640 - protein, 33 aa, Brucella spp.
QYGPYRIVRPEGQAIWLPALPQREWDQADAIFT

SEQ ID NO: 25641 - protein, 23 aa, Brucella spp.
EGMGRWAFPKTPLGETWPMQHDG

SEQ ID NO: 25642 - protein, 19 aa, Brucella spp.
SIFSAIRAWLHSLPHALAR

SEQ ID NO: 25643 - protein, 23 aa, Brucella spp.
FRDQQGVFLAEGLKLVIDALEQD

SEQ ID NO: 25644 - protein, 21 aa, Brucella spp.
ALEQDWRIKTLVFAKSGKGNK

SEQ ID NO: 25645 - protein, 17 aa, Brucella spp.
GAKGVILIGDTTDPYSL

SEQ ID NO: 25646 - protein, 26 aa, Brucella spp.
RASEADFLNWRKGFSGLVVGTHLKGA

SEQ ID NO: 25647 - protein, 27 aa, Brucella spp.
AVDYRTIPYANKPVILIMGNEQQGLPD

SEQ ID NO: 25648 - protein, 17 aa, Brucella spp.
VILIMGNEQQGLPDSLA

SEQ ID NO: 25649 - protein, 19 aa, Brucella spp.
LAIATGVMLYEIRREALTL

SEQ ID NO: 25650 - protein, 18 aa, Brucella spp.
MFYGQQIDLLPFLALFRT

SEQ ID NO: 25651 - protein, 26 aa, Brucella spp.
TLAVIAFVLYLWWTNAPERVFARYGF

SEQ ID NO: 25652 - protein, 24 aa, Brucella spp.
YVVDYVLFHLPTWSFAVFNLADAF

SEQ ID NO: 25653 - protein, 19 aa, Brucella spp.
QELRFRVFFEEMGARKETI

SEQ ID NO: 25654 - protein, 25 aa, Brucella spp.
NNKVALFSMPPLVKGYLRLGAMIGD

SEQ ID NO: 25655 - protein, 27 aa, Brucella spp.
AFGTTDVFIILPIERISSRYISYYGAE

SEQ ID NO: 25656 - protein, 32 aa, Brucella spp.
TLCAKRLCYLMDTLIDILFEFATTRAYPTRNP

SEQ ID NO: 25657 - protein, 28 aa, Brucella spp.
AQGSDIDLLFLLPYKQTPWGEQVVEYTL

SEQ ID NO: 25658 - protein, 27 aa, Brucella spp.
EQVVEYTLYMLWDMGLKVGHSTRNIDE

SEQ ID NO: 25659 - protein, 29 aa, Brucella spp.
KGGQRDLHTLFWITKYFYRVKTKEELVKL

SEQ ID NO: 25660 - protein, 19 aa, Brucella spp.
YVERFMKHYFLVAKDVGDL

SEQ ID NO: 25661 - protein, 19 aa, Brucella spp.
IFRQDPVNMIRLFHLADRH

SEQ ID NO: 25662 - protein, 23 aa, Brucella spp.
IKRDRNLLYVTLLLHDIAKGRPE

SEQ ID NO: 25663 - protein, 26 aa, Brucella spp.
QTMERLKLLLILTVCDIKAVGPGIWN

SEQ ID NO: 25664 - protein, 23 aa, Brucella spp.
GQLLRTLFYETELVLTGGFSELS

SEQ ID NO: 25665 - protein, 23 aa, Brucella spp.
RDAYLALPYTNYFLTVSLDDQVR

SEQ ID NO: 25666 - protein, 29 aa, Brucella spp.
EEVFGVLFTVLLFLAIAMELSMPFIVRTV

SEQ ID NO: 25667 - protein, 24 aa, Brucella spp.
NTVRLAIIMFPYLACMSLAAMMGG

SEQ ID NO: 25668 - protein, 25 aa, Brucella spp.
IAPVFLNIILIGVLAVAWMQGYDAL

SEQ ID NO: 25669 - protein, 25 aa, Brucella spp.
RSVEFTLFLTLPAAAALLVMSEPIV

SEQ ID NO: 25670 - protein, 24 aa, Brucella spp.
GLGLPAFVLIKAFIPGFFAREDTR

SEQ ID NO: 25671 - protein, 17 aa, Brucella spp.
PLLTRIPRLLIAAGIMA

SEQ ID NO: 25672 - protein, 18 aa, Brucella spp.
MVITAMIVYFALAFGLGG

SEQ ID NO: 25673 - protein, 28 aa, Brucella spp.
IIVDTREKFLYLIMPEGKAVRYGIGVGR

SEQ ID NO: 25674 - protein, 25 aa, Brucella spp.
CQCDMTFALFLPPQAKDGPVPVLWY

SEQ ID NO: 25675 - protein, 25 aa, Brucella spp.
AKDGPVPVLWYLSGLTCTHQNVMDK

SEQ ID NO: 25676 - protein, 27 aa, Brucella spp.
EGYDHSYFFISTFMGDHLRWHSERLRS

SEQ ID NO: 25677 - protein, 23 aa, Brucella spp.
VNALSIWLKLKIRRAGKIHEMSF

SEQ ID NO: 25678 - protein, 18 aa, Brucella spp.
VEVAMWWNDSYHEKVLCF

SEQ ID NO: 25679 - protein, 17 aa, Brucella spp.
ILPLRGKILNVERVRFD

SEQ ID NO: 25680 - protein, 23 aa, Brucella spp.
FNADKLRYHKIIIMTDADVDGAH

SEQ ID NO: 25681 - protein, 35 aa, Brucella spp.
DADVDGAHIRTLLLTFFFRQMPELIERGHIYIAQP

SEQ ID NO: 25682 - protein, 26 aa, Brucella spp.
PELIERGHIYIAQPPLYKVTRGKSSQ

SEQ ID NO: 25683 - protein, 27 aa, Brucella spp.
LVDGSGYIFRAYHALPPLTRKTDGLPV

SEQ ID NO: 25684 - protein, 25 aa, Brucella spp.
GAVSGFCNMLWKLLKDARNTDVGVV

SEQ ID NO: 25685 - protein, 19 aa, Brucella spp.
VVPTHFAVIFDYSSKTFRK

SEQ ID NO: 25686 - protein, 18 aa, Brucella spp.
LIPQFGLIRQATRAFNLP

SEQ ID NO: 25687 - protein, 23 aa, Brucella spp.
DTSAYVCIRDIATLEQWLAEAAE

SEQ ID NO: 25688 - protein, 23 aa, Brucella spp.
VENQIPLDMALAALKRVLEDASI

SEQ ID NO: 25689 - protein, 25 aa, Brucella spp.
QNMKYDWLVMRRHGINAVSFDDTML

SEQ ID NO: 25690 - protein, 28 aa, Brucella spp.
AEDADVTLRLWQVLKPRLAAEGLMSVYE

SEQ ID NO: 25691 - protein, 26 aa, Brucella spp.
RRAKAINFGIIYGISAFGLANQLSIP

SEQ ID NO: 25692 - protein, 26 aa, Brucella spp.
EAGQYIRTYFERFPGIKDYMEATKAF

SEQ ID NO: 25693 - protein, 24 aa, Brucella spp.
ENLAARMLLQVHDELIFEVPENEV

SEQ ID NO: 25694 - protein, 28 aa, Brucella spp.
NLNKSLDRLFNLLRIKSISTDPAYKADC

SEQ ID NO: 25695 - protein, 26 aa, Brucella spp.
TADAPHVLFYGHYDVQPVDPLSLWEN

SEQ ID NO: 25696 - protein, 26 aa, Brucella spp.
GAAANPIHILTKILADLHDETGRITI

SEQ ID NO: 25697 - protein, 23 aa, Brucella spp.
EWPKPAVLIAMGGSIPIVGDFNT

SEQ ID NO: 25698 - protein, 26 aa, Brucella spp.
PIVGDFNTFLGMESLLVGFGLEDDRI

SEQ ID NO: 25699 - protein, 28 aa, Brucella spp.
KDRSITKIFHFGRFDLAVLAHAFGTMPQ

SEQ ID NO: 25700 - protein, 21 aa, Brucella spp.
ASDVLYLHRLKAVLEQRLERD

SEQ ID NO: 25701 - protein, 17 aa, Brucella spp.
LHRLKAVLEQRLERDGR

SEQ ID NO: 25702 - protein, 24 aa, Brucella spp.
GESWRVRYFAPEMEVPFCGHATIA

SEQ ID NO: 25703 - protein, 30 aa, Brucella spp.
VTMSRQGWTTILLIYSETPRRFHARNPFAS

SEQ ID NO: 25704 - protein, 34 aa, Brucella spp.
IRSLLDTDFYKLLMLQMIWGLYPRVDATFSLINR

SEQ ID NO: 25705 - protein, 24 aa, Brucella spp.
YGRKQIFQPEFLAWLHDCQLPEYE

SEQ ID NO: 25706 - protein, 27 aa, Brucella spp.
ARRDLPRRFIRQLPLYKVPLEQYEGMP

SEQ ID NO: 25707 - protein, 29 aa, Brucella spp.
LEQYEGMPRIFALAWLYVAHTDSNFSLKM

SEQ ID NO: 25708 - protein, 43 aa, Brucella spp.
FGVKALRLYRGLGLWGLFVPTAIFTVLTLLLVNYCMMRAGLST

SEQ ID NO: 25709 - protein, 31 aa, Brucella spp.
GLSTDLRTLFTLLAIFPAMDASYSLFNVLVP

SEQ ID NO: 25710 - protein, 30 aa, Brucella spp.
DASYSLFNVLVPWFVQPTRLIGFEYKDGLP

SEQ ID NO: 25711 - protein, 27 aa, Brucella spp.
YTGDDQPRFFLLHRRRLFNEKQGCWMG

SEQ ID NO: 25712 - protein, 17 aa, Brucella spp.
RHHRWARGDWQLLPWLF

SEQ ID NO: 25713 - protein, 28 aa, Brucella spp.
HRWARGDWQLLPWLFSTGRGVSAITRWK

SEQ ID NO: 25714 - protein, 30 aa, Brucella spp.
DNLRRSLNPILWLIAAIVGWSVLPLGAAAV

SEQ ID NO: 25715 - protein, 31 aa, Brucella spp.
PLGAAAVWQGFLILSMFVAPTFGIVTNLIPA

SEQ ID NO: 25716 - protein, 26 aa, Brucella spp.
DAIARTIYRLFISRRNLLEWRTAAQA

SEQ ID NO: 25717 - protein, 34 aa, Brucella spp.
ARTSPDTLLFYFQLMWPAMAIAGLAIFFPLAAES

SEQ ID NO: 25718 - protein, 29 aa, Brucella spp.
AALIAAPFVVIWFASPLIAWLVSRSAKPQ

SEQ ID NO: 25719 - protein, 26 aa, Brucella spp.
GDVPVEHWFKLGRLLVPVGWKGALLS

SEQ ID NO: 25720 - protein, 24 aa, Brucella spp.
SWSGSMFEYLMPPLVMSEPLGSLL

SEQ ID NO: 25721 - protein, 25 aa, Brucella spp.
DMQGTFLFLRDMESGYWWSATGEPV

SEQ ID NO: 25722 - protein, 24 aa, Brucella spp.
TSTPHPWINVIANPSFGFHVSAEG

SEQ ID NO: 25723 - protein, 17 aa, Brucella spp.
FDLMVNGWLPYQAVACR

SEQ ID NO: 25724 - protein, 23 aa, Brucella spp.
EGDVQHWWLPATGAGVRTLISDD

SEQ ID NO: 25725 - protein, 18 aa, Brucella spp.
LISDDVVWLSYGASLYVE

SEQ ID NO: 25726 - protein, 18 aa, Brucella spp.
VVWLSYGASLYVETTGDR

SEQ ID NO: 25727 - protein, 30 aa, Brucella spp.
KGKGESVWLGWFLAYTLKAFIPLAEARKDQ

SEQ ID NO: 25728 - protein, 19 aa, Brucella spp.
LDEDNALLRLFTPPFDVTP

SEQ ID NO: 25729 - protein, 17 aa, Brucella spp.
LRLFTPPFDVTPQEPGY

SEQ ID NO: 25730 - protein, 17 aa, Brucella spp.
AEAWRLFSLISPVSHGR

SEQ ID NO: 25731 - protein, 27 aa, Brucella spp.
QERNVGFVFQHYALFRHMTVADNIGFG

SEQ ID NO: 25732 - protein, 17 aa, Brucella spp.
LFRHMTVADNIGFGLKV

SEQ ID NO: 25733 - protein, 18 aa, Brucella spp.
AIEPRVLLLDEPFGALDA

SEQ ID NO: 25734 - protein, 18 aa, Brucella spp.
KPNSPFVYGFIGESSTLP

SEQ ID NO: 25735 - protein, 17 aa, Brucella spp.
YFRPHDVELLDGCGGCI

SEQ ID NO: 25736 - protein, 30 aa, Brucella spp.
AAEKSRIAFRPRYWTLFRAGDSELPAPKAA

SEQ ID NO: 25737 - protein, 20 aa, Brucella spp.
PFAILLSLAAMTLPSVAMNA

SEQ ID NO: 25738 - protein, 25 aa, Brucella spp.
EDFGKPIIAVVNSFTQFVPGHVHLK

SEQ ID NO: 25739 - protein, 34 aa, Brucella spp.
NCDKITPGMLMAALRLNIPVVFVSGGPMEAGKVV

SEQ ID NO: 25740 - protein, 25 aa, Brucella spp.
HADRKRLFVEAGHLIVDLARRYYEQ

SEQ ID NO: 25741 - protein, 25 aa, Brucella spp.
GGPGMQEMLYPTSYLKSKGLGKACA

SEQ ID NO: 25742 - protein, 25 aa, Brucella spp.
QGSTVRIMYIHVPFAWLSMMCYSIM

SEQ ID NO: 25743 - protein, 24 aa, Brucella spp.
KPMWGTWWVWDARLTSVFVLFLMY

SEQ ID NO: 25744 - protein, 27 aa, Brucella spp.
ARLTSVFVLFLMYLGIIALSRAMDDPA

SEQ ID NO: 25745 - protein, 26 aa, Brucella spp.
GSMLRPLFVMAIGFTLLFFTLHMMAM

SEQ ID NO: 25746 - protein, 25 aa, Brucella spp.
GALIGILFFLAVISVMPFGVGPDLN

SEQ ID NO: 25747 - protein, 24 aa, Brucella spp.
ARIGPAMLWIGALLATLLGLDRLF

SEQ ID NO: 25748 - protein, 23 aa, Brucella spp.
GLLVSVIVLPLTIPVLIFGVSAS

SEQ ID NO: 25749 - protein, 27 aa, Brucella spp.
AVAPFFASFLILAALTLFFAVLGPLAA

SEQ ID NO: 25750 - protein, 25 aa, Brucella spp.
SVRENLLFWQKFNGGEALDIGAALE

SEQ ID NO: 25751 - protein, 26 aa, Brucella spp.
RVSIAKLLVSHRPLWIVDEPTAGLDK

SEQ ID NO: 25752 - protein, 26 aa, Brucella spp.
AGISSLPFSMKVLLENLLRFEDDRSV

SEQ ID NO: 25753 - protein, 23 aa, Brucella spp.
YRPARVLMQDFTGVPAVVDLAAM

SEQ ID NO: 25754 - protein, 27 aa, Brucella spp.
QRNGERYRFLKWGQQAFKNFRVVPPGT

SEQ ID NO: 25755 - protein, 27 aa, Brucella spp.
AMLGQPVSMLLPEVIGFRLTGKLKEGV

SEQ ID NO: 25756 - protein, 24 aa, Brucella spp.
GVVGKFVEFFGAGLDNMSLADRAT

SEQ ID NO: 25757 - protein, 26 aa, Brucella spp.
DKDGNPVYLRDIWPSTQEIQDFIAKN

SEQ ID NO: 25758 - protein, 30 aa, Brucella spp.
RIHRSNLVGMGIVPFVFEEGTSWQSLGLKG

SEQ ID NO: 25759 - protein, 24 aa, Brucella spp.
VKKVPLICRIDTLDELDYMKNGGI

SEQ ID NO: 25760 - protein, 26 aa, Brucella spp.
PNVLALSFHVNYWDYMGWRDTLATQD

SEQ ID NO: 25761 - protein, 28 aa, Brucella spp.
PRDPVHVVLFYFRDSATIPITEGENAGK

SEQ ID NO: 25762 - protein, 26 aa, Brucella spp.
FASPLRWVIMLAPLAAVFFLSFRIQS

SEQ ID NO: 25763 - protein, 18 aa, Brucella spp.
VERFSQFLTLVGLTALIV

SEQ ID NO: 25764 - protein, 18 aa, Brucella spp.
QFLTLVGLTALIVGGVGV

SEQ ID NO: 25765 - protein, 32 aa, Brucella spp.
LGAPARFAVLVYLIQIMVIGLIGIAIGLVLAA

SEQ ID NO: 25766 - protein, 18 aa, Brucella spp.
GLVTTLAFAIIPLGRARD

SEQ ID NO: 25767 - protein, 27 aa, Brucella spp.
EQRGRPALFYLGLAILLIAALAGLALY

SEQ ID NO: 25768 - protein, 17 aa, Brucella spp.
WETLAMNFVMVFSPDTF

SEQ ID NO: 25769 - protein, 19 aa, Brucella spp.
LAMNFVMVFSPDTFAGAPA

SEQ ID NO: 25770 - protein, 28 aa, Brucella spp.
TLIAAYVMEYMLLGLATAIFALVVGGVA

SEQ ID NO: 25771 - protein, 34 aa, Brucella spp.
VAGRYVVVEIMKLKAIFLPDVALMTVVIALVLTV

SEQ ID NO: 25772 - protein, 17 aa, Brucella spp.
PAAAMLKALLVSLLALF

SEQ ID NO: 25773 - protein, 36 aa, Brucella spp.
FNPIYPRLARKYDVPLYPFFLDGVATRKGLLLEDGM

SEQ ID NO: 25774 - protein, 19 aa, Brucella spp.
IDVENYHITLRFIGDVEGH

SEQ ID NO: 25775 - protein, 24 aa, Brucella spp.
RVRRPEFMLNLSGVDAFGSKKPHS

SEQ ID NO: 25776 - protein, 20 aa, Brucella spp.
PNAKVIVTIGNRNFTMFVNG

SEQ ID NO: 25777 - protein, 27 aa, Brucella spp.
IVTIGNRNFTMFVNGKSGWMENAAEEP

SEQ ID NO: 25778 - protein, 32 aa, Brucella spp.
PERQVKMRISQLWHWLYVRGVSDFADMRNISK

SEQ ID NO: 25779 - protein, 26 aa, Brucella spp.
QDGTRKWLFRFPPRGAGRPVEIESVY

SEQ ID NO: 25780 - protein, 23 aa, Brucella spp.
RKITNIVMMGMGEPLYNFEEVKK

SEQ ID NO: 25781 - protein, 24 aa, Brucella spp.
DDAKLLVKLLQGIPAKINLIPFNP

SEQ ID NO: 25782 - protein, 25 aa, Brucella spp.
IPAKINLIPFNPWPGTNYQCSDWEQ

SEQ ID NO: 25783 - protein, 31 aa, Brucella spp.
EDVREEFVRDFVFPMFRANAVYEGVYLLGTS

SEQ ID NO: 25784 - protein, 35 aa, Brucella spp.
AHLKDELMPRYAELIYYGFWFSPEREMLQAAIDHS

SEQ ID NO: 25785 - protein, 24 aa, Brucella spp.
AGAIAMLFYFLPNMPAVTSISSGV

SEQ ID NO: 25786 - protein, 22 aa, Brucella spp.
SPTKWFLRRFDHSAIYLLIAGT

SEQ ID NO: 25787 - protein, 24 aa, Brucella spp.
RALPLLLFVWSVAFVGIMLKLFMP

SEQ ID NO: 25788 - protein, 21 aa, Brucella spp.
EIALLFEQMVNQPQDAHEIRE

SEQ ID NO: 25789 - protein, 25 aa, Brucella spp.
TEAITLILRKWLTHERYLSAEPEQG

SEQ ID NO: 25790 - protein, 39 aa, Brucella spp.
GAAFNWDAFHLADQLLTQPLQIIIGGGQPGIFGSFRDGY

SEQ ID NO: 25791 - protein, 25 aa, Brucella spp.
RSQTKNLFIVPGATHYDLYDKPEYV

SEQ ID NO: 25792 - protein, 25 aa, Brucella spp.
SLGLVSDIFIADGKVFFSITVPAER

SEQ ID NO: 25793 - protein, 27 aa, Brucella spp.
VDEETPMIWRGPMVMSALTQMLREVAW

SEQ ID NO: 25794 - protein, 26 aa, Brucella spp.
DARKGLNMFRKVDVPLLGIVENMSYF

SEQ ID NO: 25795 - protein, 17 aa, Brucella spp.
GIVENMSYFIAPDTGTR

SEQ ID NO: 25796 - protein, 24 aa, Brucella spp.
EAERLNVPFLGEVPLHMDVRAYSD

SEQ ID NO: 25797 - protein, 24 aa, Brucella spp.
DTMKNHRLFASAISVFALCASAGI

SEQ ID NO: 25798 - protein, 25 aa, Brucella spp.
NLPSDFYDEFVVVGQLAPFDKDTTL

SEQ ID NO: 25799 - protein, 28 aa, Brucella spp.
MQLKSGSYHLMFIEPEHPYEEGETVPVT

SEQ ID NO: 25800 - protein, 26 aa, Brucella spp.
TGPECAIFSPLIDASLRPFAATAAAC

SEQ ID NO: 25801 - protein, 27 aa, Brucella spp.
GFETGSIIPWEMTWSLYLEELGPSEAT

SEQ ID NO: 25802 - protein, 17 aa, Brucella spp.
RRRFLLGTGAVLLTGAA

SEQ ID NO: 25803 - protein, 29 aa, Brucella spp.
TIVVSLKDHFLYYVLPGGEALRYGVGIGK

SEQ ID NO: 25804 - protein, 23 aa, Brucella spp.
VEYKKQWPRWTPPPEMIQRKPEL

SEQ ID NO: 25805 - protein, 23 aa, Brucella spp.
AFFVFVVAAAVFAWPEQKVQMPA

SEQ ID NO: 25806 - protein, 40 aa, Brucella spp.
VADREGVWLRIENVKLDWSRTALFLGRLSVQSLTAERIDV

SEQ ID NO: 25807 - protein, 22 aa, Brucella spp.
SSFSLPELPISINLEQLDVARL

SEQ ID NO: 25808 - protein, 26 aa, Brucella spp.
NLEQLDVARLHFGPTIFGLESDVSLK

SEQ ID NO: 25809 - protein, 35 aa, Brucella spp.
VFAARFNGPIAVLVPPVFRDFFGAETVLSADGLVK

SEQ ID NO: 25810 - protein, 25 aa, Brucella spp.
ASDKADFDFGVMLSDLKLLSDKASG

SEQ ID NO: 25811 - protein, 21 aa, Brucella spp.
EKRLTNLMFNAGGAHLSGNVT

SEQ ID NO: 25812 - protein, 21 aa, Brucella spp.
DLSVALTNLPLALANTFKPEL

SEQ ID NO: 25813 - protein, 32 aa, Brucella spp.
KGDLALDVNLTNLPLVLLNGVVKGQDLAGNVT

SEQ ID NO: 25814 - protein, 17 aa, Brucella spp.
GSFDLIRGRISILGQRI

SEQ ID NO: 25815 - protein, 18 aa, Brucella spp.
DLIRGRISILGQRITFDE

SEQ ID NO: 25816 - protein, 29 aa, Brucella spp.
ELPQDEVLAQLIFKRSIGKLSAFQIAQLA

SEQ ID NO: 25817 - protein, 29 aa, Brucella spp.
SSFALSPALAFEIFGIHLWGKDKKQDPDI

SEQ ID NO: 25818 - protein, 25 aa, Brucella spp.
VDPGPQFLFSRTAISNIAPPPGNRR

SEQ ID NO: 25819 - protein, 25 aa, Brucella spp.
TARMDPQFVAWMTGLKPGQEYDPDD

SEQ ID NO: 25820 - protein, 25 aa, Brucella spp.
FGVTSYWMHRNLLGRGERLRFDAKV

SEQ ID NO: 25821 - protein, 23 aa, Brucella spp.
FDPKNYTYLLGASFAKPGVYTPD

SEQ ID NO: 25822 - protein, 35 aa, Brucella spp.
PDPSSGFYLVGNIQPFYEFHYGNFATRFTAEGRTY

SEQ ID NO: 25823 - protein, 24 aa, Brucella spp.
IAAVQILVHLIYFLYLDPKSEGGW

SEQ ID NO: 25824 - protein, 19 aa, Brucella spp.
LVGFWIYLMSDCILFSGLF

SEQ ID NO: 25825 - protein, 17 aa, Brucella spp.
TSGLIWILVLSAMLLRD

SEQ ID NO: 25826 - protein, 17 aa, Brucella spp.
WILVLSAMLLRDGLTER

SEQ ID NO: 25827 - protein, 31 aa, Brucella spp.
RTRVMCLSLFWHFLDIIWIGVFTLVYLLGVL

SEQ ID NO: 25828 - protein, 26 aa, Brucella spp.
DHKRIGVMYIVLALVMLFRGFSDAVM

SEQ ID NO: 25829 - protein, 27 aa, Brucella spp.
FTAHGVIMIFFVAMPFIVGLMNFVVPL

SEQ ID NO: 25830 - protein, 29 aa, Brucella spp.
AGGNPMMYVNLIWIWGHPEVYILVLPCFG

SEQ ID NO: 25831 - protein, 32 aa, Brucella spp.
LGKNAFWCWLVGFMLAFMPLYVLGLMGMTRRL

SEQ ID NO: 25832 - protein, 17 aa, Brucella spp.
AWHIYLIIAAIGVAVIL

SEQ ID NO: 25833 - protein, 33 aa, Brucella spp.
GILSIPFGFAMIWHIWWLAIASALAMFVVAIAH

SEQ ID NO: 25834 - protein, 36 aa, Brucella spp.
EERDLILFATGIMLLVVVPVILATLFFAWKYRATNE

SEQ ID NO: 25835 - protein, 25 aa, Brucella spp.
TKIELAVWLIPMAIIVVLGTVTWIS

SEQ ID NO: 25836 - protein, 27 aa, Brucella spp.
EVVALDWKWLFIYPDQGIATVNEMAMP

SEQ ID NO: 25837 - protein, 29 aa, Brucella spp.
AGQMVATIKIIPFAVPGVLIEEIRAVVHG

SEQ ID NO: 25838 - protein, 19 aa, Brucella spp.
EILRIGMPVDPGNLLVLGK

SEQ ID NO: 25839 - protein, 24 aa, Brucella spp.
VDPGNLLVLGKMGRKYIIAAPGSA

SEQ ID NO: 25840 - protein, 19 aa, Brucella spp.
VVMTTGILSDSLFHSPAPE

SEQ ID NO: 25841 - protein, 25 aa, Brucella spp.
AAGNKWDFEHLNKFLTSPKGFIKGT

SEQ ID NO: 25842 - protein, 25 aa, Brucella spp.
NERADLIAYLRTLSDNPVPLPAADA

SEQ ID NO: 25843 - protein, 25 aa, Brucella spp.
GNRRLRALYFTRATAPYGEGPLYHH

SEQ ID NO: 25844 - protein, 26 aa, Brucella spp.
PYGEGPLYHHIGLYAYRRSALERFVK

SEQ ID NO: 25845 - protein, 25 aa, Brucella spp.
GRVADIHYLLPLADMHIVGEYFLPI

SEQ ID NO: 25846 - protein, 32 aa, Brucella spp.
ADMHIVGEYFLPIHFQLMVLPGVRREEIKTVH

SEQ ID NO: 25847 - protein, 23 aa, Brucella spp.
RIVTTFVFRVRNVPAALYKALGG

SEQ ID NO: 25848 - protein, 25 aa, Brucella spp.
ELPETRIMILGDHKLLLDYGQEDAP

SEQ ID NO: 25849 - protein, 24 aa, Brucella spp.
EEAHQFVLDLCEPVLLGLQDGTPL

SEQ ID NO: 25850 - protein, 26 aa, Brucella spp.
AYHASQPWPFPYSLMIGCHAEVLSDD

SEQ ID NO: 25851 - protein, 33 aa, Brucella spp.
LCELRLMNDRRWPWLILVPRRPGLTEIHQMTPL

SEQ ID NO: 25852 - protein, 25 aa, Brucella spp.
ARYKVYIIDEVHMLSTAAFNGLLKT

SEQ ID NO: 25853 - protein, 28 aa, Brucella spp.
TLEEPPPHVKFIFATTEIRKVPITVLSR

SEQ ID NO: 25854 - protein, 29 aa, Brucella spp.
GLADRARIIDLFEMLMRGDVAGALTEFRA

SEQ ID NO: 25855 - protein, 24 aa, Brucella spp.
IRALSRTWQMLLKGIAEVDTATRP

SEQ ID NO: 25856 - protein, 27 aa, Brucella spp.
PVQAAEMLLIRLAHAADLPTLDEAIRG

SEQ ID NO: 25857 - protein, 19 aa, Brucella spp.
DKYRDMQFKILVKNCVRPA

SEQ ID NO: 25858 - protein, 18 aa, Brucella spp.
DMQFKILVKNCVRPASIA

SEQ ID NO: 25859 - protein, 28 aa, Brucella spp.
LPSDIAQHLLNWTGIRWVVTVARDVAGQ

SEQ ID NO: 25860 - protein, 23 aa, Brucella spp.
KEDEVEILEDLIIAAHNDAKAKL

SEQ ID NO: 25861 - protein, 24 aa, Brucella spp.
EIERLIQLLARVPGLGPRSARRAA

SEQ ID NO: 25862 - protein, 25 aa, Brucella spp.
ARRAALHLIKKKEALLVPLGGAMQE

SEQ ID NO: 25863 - protein, 22 aa, Brucella spp.
ADTMNVRYHVLGGRLSPLDGIG

SEQ ID NO: 25864 - protein, 21 aa, Brucella spp.
VVLTLPLLVPLLGLSFTQYGI

SEQ ID NO: 25865 - protein, 19 aa, Brucella spp.
LVRVLMLGPVILVFALISG

SEQ ID NO: 25866 - protein, 17 aa, Brucella spp.
LMLGPVILVFALISGNK

SEQ ID NO: 25867 - protein, 33 aa, Brucella spp.
NADVKPGFFQLVPWFIIGFLAMMALHSLHLIPE

SEQ ID NO: 25868 - protein, 20 aa, Brucella spp.
LDGAVAFLPRSQVDIRPIRD

SEQ ID NO: 25869 - protein, 39 aa, Brucella spp.
AFLPRSQVDIRPIRDVTPLMHVPQPFEILKMDKRRGNIV

SEQ ID NO: 25870 - protein, 20 aa, Brucella spp.
LHVTDMAWRRVNHPSEILTI

SEQ ID NO: 25871 - protein, 21 aa, Brucella spp.
TLDNPWTTFAQKYPVGTVVEG

SEQ ID NO: 25872 - protein, 22 aa, Brucella spp.
KNKTEFGLFIGLDGDVDGMVHL

SEQ ID NO: 25873 - protein, 24 aa, Brucella spp.
IATHYGMPHLDTGLTYRAVAKALL

SEQ ID NO: 25874 - protein, 18 aa, Brucella spp.
VCPDAAIKLFVTASPEVR

SEQ ID NO: 25875 - protein, 17 aa, Brucella spp.
SHRSFMFGGLASGKTRI

SEQ ID NO: 25876 - protein, 17 aa, Brucella spp.
MFGGLASGKTRITGLLE

SEQ ID NO: 25877 - protein, 18 aa, Brucella spp.
RKEGDVWIINGVGNGCLL

SEQ ID NO: 25878 - protein, 17 aa, Brucella spp.
GDVWIINGVGNGCLLQP

SEQ ID NO: 25879 - protein, 17 aa, Brucella spp.
VWIINGVGNGCLLQPEA

SEQ ID NO: 25880 - protein, 22 aa, Brucella spp.
DRMPLTLIGPRTANPIAYRVPM

SEQ ID NO: 25881 - protein, 25 aa, Brucella spp.
VTIRNVLMNPTRTGLILTLQEMGAD

SEQ ID NO: 25882 - protein, 18 aa, Brucella spp.
SMIDEYPVLAIAASFAEG

SEQ ID NO: 25883 - protein, 32 aa, Brucella spp.
GTVGTHLDHRIAMSFLVMGLASEKPVTVDDST

SEQ ID NO: 25884 - protein, 26 aa, Brucella spp.
MIATSFPEFMGMMAGLGAKIAESGAE

SEQ ID NO: 25885 - protein, 17 aa, Brucella spp.
QGFILTFAYFTDVFFIV

SEQ ID NO: 25886 - protein, 28 aa, Brucella spp.
VSWSLSALFFMYLAFPFFDLLCRRLGNG

SEQ ID NO: 25887 - protein, 28 aa, Brucella spp.
NARYSFTIFILHPLVALFFFKATPEQWG

SEQ ID NO: 25888 - protein, 20 aa, Brucella spp.
ENRLPCIYLVDSGGANLPNQ

SEQ ID NO: 25889 - protein, 17 aa, Brucella spp.
CIYLVDSGGANLPNQDE

SEQ ID NO: 25890 - protein, 29 aa, Brucella spp.
ELCCQRNIPLVFLQNITGFMVGRKYEAEG

SEQ ID NO: 25891 - protein, 29 aa, Brucella spp.
MAGRAYSPRFLWTWPNSRIAVMGGEQAAG

SEQ ID NO: 25892 - protein, 25 aa, Brucella spp.
IPRGKNVMFQKILIANRGEIACRVI

SEQ ID NO: 25893 - protein, 23 aa, Brucella spp.
VEEAGLIFIGPSAKAIRAMGLKD

SEQ ID NO: 25894 - protein, 28 aa, Brucella spp.
SEGLRPDRFFFMEMNTRLQVEHPVTEAI

SEQ ID NO: 25895 - protein, 24 aa, Brucella spp.
EDPARDFLPATGKLALFVPPENAR

SEQ ID NO: 25896 - protein, 26 aa, Brucella spp.
RTGDTITPFYDPMIAKIITHGATRDE

SEQ ID NO: 25897 - protein, 17 aa, Brucella spp.
QPSDIAFALAALGALDL

SEQ ID NO: 25898 - protein, 24 aa, Brucella spp.
WSGLRGFRLWGEASRSVLIEHHGE

SEQ ID NO: 25899 - protein, 25 aa, Brucella spp.
ASSESRILSPMPGLVRLVSVVEGAS

SEQ ID NO: 25900 - protein, 23 aa, Brucella spp.
YADITIGVIAPLTGPVAAFGDQV

SEQ ID NO: 25901 - protein, 25 aa, Brucella spp.
IVGDGIKFVVGLVTTGVAVPVSDVL

SEQ ID NO: 25902 - protein, 25 aa, Brucella spp.
LERYARHIVLPVIGGPGQQKLKAAR

SEQ ID NO: 25903 - protein, 28 aa, Brucella spp.
IGEPLVGRLLLYNALNVRFETIRYKARK

SEQ ID NO: 25904 - protein, 24 aa, Brucella spp.
IRRLKLVNFRNYAELSLPLGPGHV

SEQ ID NO: 25905 - protein, 31 aa, Brucella spp.
ASADDLLDYARILWVVPSMDGLFTGGASDRR

SEQ ID NO: 25906 - protein, 24 aa, Brucella spp.
ASDRRRFLDRMVLAIDTAHGKRVL

SEQ ID NO: 25907 - protein, 25 aa, Brucella spp.
TGEQKALLIGLILAHARLTAELSGM

SEQ ID NO: 25908 - protein, 25 aa, Brucella spp.
ATTVPAHLLYDIVRKLPDGAEVMLS

SEQ ID NO: 25909 - protein, 31 aa, Brucella spp.
ISTEETRYYLNGIFFHAIESDGALKLRAVAT

SEQ ID NO: 25910 - protein, 24 aa, Brucella spp.
SGTDAVFMLADAGSPTLVRDTGDE

SEQ ID NO: 25911 - protein, 22 aa, Brucella spp.
ASRPIWFVAKNALDEAALPESA

SEQ ID NO: 25912 - protein, 24 aa, Brucella spp.
MDAKLPVRLRVLIPAIENAIAGNA

SEQ ID NO: 25913 - protein, 29 aa, Brucella spp.
ARETADPLWRMPLWQPYAQKLSSRVADIN

SEQ ID NO: 25914 - protein, 28 aa, Brucella spp.
FVKRARQWAHFDIFGWVPVEKPASPVGG

SEQ ID NO: 25915 - protein, 18 aa, Brucella spp.
IAGFALGLAAFFPSAVSV

SEQ ID NO: 25916 - protein, 23 aa, Brucella spp.
VNGIEMYYRVVGKGPPILLIHGG

SEQ ID NO: 25917 - protein, 17 aa, Brucella spp.
KGPPILLIHGGLSDQHV

SEQ ID NO: 25918 - protein, 18 aa, Brucella spp.
ILLIHGGLSDQHVWDAQL

SEQ ID NO: 25919 - protein, 18 aa, Brucella spp.
ALLDYLHIDKVDLVGWSD

SEQ ID NO: 25920 - protein, 24 aa, Brucella spp.
VRPDDWYFPCHFQGNPIMPGCLGL

SEQ ID NO: 25921 - protein, 26 aa, Brucella spp.
CLGLDGMWQLTGFFLGWLGEPGRGMA

SEQ ID NO: 25922 - protein, 26 aa, Brucella spp.
TASATLATFFKIKGINYSISSACATS

SEQ ID NO: 25923 - protein, 27 aa, Brucella spp.
AGGCEDLDWTLSVLFDAMGAMSSKYND

SEQ ID NO: 25924 - protein, 27 aa, Brucella spp.
TGVQEAIYSLLMMQNNFICESAHIEEL

SEQ ID NO: 25925 - protein, 30 aa, Brucella spp.
DNHSRRGLLKLVSQRRRLLDYVKGVDHARY

SEQ ID NO: 25926 - protein, 18 aa, Brucella spp.
PISGWVIFDKPKGMGSTE

SEQ ID NO: 25927 - protein, 24 aa, Brucella spp.
EAVSKIKWLFSAEKAGHAGTLDPL

SEQ ID NO: 25928 - protein, 22 aa, Brucella spp.
MDGTKVYRFTVTWGEERSTDDL

SEQ ID NO: 25929 - protein, 25 aa, Brucella spp.
MVTLAKLEAVWPPLPPKDEDGNVIE

SEQ ID NO: 25930 - protein, 20 aa, Brucella spp.
VLLSERLVGLFGFVLCEHVP

SEQ ID NO: 25931 - protein, 20 aa, Brucella spp.
QMKYMPEFRFRPDTSFDNFS

SEQ ID NO: 25932 - protein, 29 aa, Brucella spp.
RMAERSVDIIKYLMKQGQMMKPGDVIDAD

SEQ ID NO: 25933 - protein, 26 aa, Brucella spp.
VQNGQKITFIDTPGHAAFTAMRARGA

SEQ ID NO: 25934 - protein, 22 aa, Brucella spp.
AKAAGVPIIVAINKIDKPAADP

SEQ ID NO: 25935 - protein, 29 aa, Brucella spp.
SAKNKINLDKLLDAVLLQAEMLDLKADPD

SEQ ID NO: 25936 - protein, 20 aa, Brucella spp.
GPAMPVEILGLQGTPQAGDR

SEQ ID NO: 25937 - protein, 34 aa, Brucella spp.
SAEQQGIEIRYYNIIYDLIDDVKAAMSGLLSPER

SEQ ID NO: 25938 - protein, 18 aa, Brucella spp.
FLGNAEILEVFNITKVGK

SEQ ID NO: 25939 - protein, 23 aa, Brucella spp.
GSADDMIRFVAGPDGSVVPDLKQ

SEQ ID NO: 25940 - protein, 20 aa, Brucella spp.
VVHLEGPEIPSFTLFSGEEM

SEQ ID NO: 25941 - protein, 17 aa, Brucella spp.
IPSFTLFSGEEMDLAFG

SEQ ID NO: 25942 - protein, 39 aa, Brucella spp.
REQRGPQIFLSRTHPQFMAKLFTMEVPEIYDGIIEIKSV

SEQ ID NO: 25943 - protein, 27 aa, Brucella spp.
LQGEKIDIIPWSPDAASFIVNALQPAE

SEQ ID NO: 25944 - protein, 24 aa, Brucella spp.
YEQDGFNWRTVKVDVLLHPQSADI

SEQ ID NO: 25945 - protein, 33 aa, Brucella spp.
FGYACRETLDLMPAPIYYSHKILEKLAEARHKG

SEQ ID NO: 25946 - protein, 18 aa, Brucella spp.
SVVEPYIREALGDLPIAE

SEQ ID NO: 25947 - protein, 17 aa, Brucella spp.
EPYIREALGDLPIAENC

SEQ ID NO: 25948 - protein, 17 aa, Brucella spp.
YIREALGDLPIAENCNW

SEQ ID NO: 25949 - protein, 25 aa, Brucella spp.
PIAENCNWYINPTGKFVIGGPDGDA

SEQ ID NO: 25950 - protein, 18 aa, Brucella spp.
LDLNKPIYAKTSFYGHFG

SEQ ID NO: 25951 - protein, 19 aa, Brucella spp.
PFDIFVAGFVSFPVLVWLI

SEQ ID NO: 25952 - protein, 18 aa, Brucella spp.
VSFPVLVWLIDGAIARTD

SEQ ID NO: 25953 - protein, 29 aa, Brucella spp.
LAAKVGWWFGFGYFVSGLWWIGTALLVDA

SEQ ID NO: 25954 - protein, 26 aa, Brucella spp.
LGLPAFLALFYAFAAMIARLLWSDGL

SEQ ID NO: 25955 - protein, 31 aa, Brucella spp.
FGFALAEWLRTFIFTGFPWNLIGYAAMPVPL

SEQ ID NO: 25956 - protein, 24 aa, Brucella spp.
KPRPDVIVWPETAIPYILESTPQA

SEQ ID NO: 25957 - protein, 19 aa, Brucella spp.
GWIQTVLILLTLLAASVGL

SEQ ID NO: 25958 - protein, 28 aa, Brucella spp.
MKEKVDPYLRPLYDALYDMMPAEKVERA

SEQ ID NO: 25959 - protein, 25 aa, Brucella spp.
TSMQMKMFLTRLGEGSRMIVTGDPS

SEQ ID NO: 25960 - protein, 23 aa, Brucella spp.
EGCDKFCTFCVVPYTRGSEVSRS

SEQ ID NO: 25961 - protein, 28 aa, Brucella spp.
REWGLGELLFRLARIPGIAHLRYTTSHP

SEQ ID NO: 25962 - protein, 30 aa, Brucella spp.
IAAHRDLRQLMPYLHLPVQSGSDRILKAMN

SEQ ID NO: 25963 - protein, 28 aa, Brucella spp.
AGQMVGRSPWLLPVIIDDNKDRVGDIIH

SEQ ID NO: 25964 - protein, 20 aa, Brucella spp.
RSLIAQDTIFGFIARPQGKP

SEQ ID NO: 25965 - protein, 22 aa, Brucella spp.
LMDGVLRHLYQERAETLFLEVD

SEQ ID NO: 25966 - protein, 19 aa, Brucella spp.
PLREIERIAINIGPGSFTG

SEQ ID NO: 25967 - protein, 25 aa, Brucella spp.
EIQAQMPEKPVLVLLDAHRGEIYAQ

SEQ ID NO: 25968 - protein, 18 aa, Brucella spp.
VLVLLDAHRGEIYAQGFD

SEQ ID NO: 25969 - protein, 23 aa, Brucella spp.
LGGRFALVLPEPTAPIGTYARLA

SEQ ID NO: 25970 - protein, 25 aa, Brucella spp.
GDAPKPLYMRGPDAKPQLGFALPRR

SEQ ID NO: 25971 - protein, 26 aa, Brucella spp.
ALITKQAHWNLKGPQFIAVHEMLDGF

SEQ ID NO: 25972 - protein, 18 aa, Brucella spp.
TDIYAVHDHLVALIERYG

SEQ ID NO: 25973 - protein, 18 aa, Brucella spp.
RSLDKALWFLEAHVQESN

SEQ ID NO: 25974 - protein, 20 aa, Brucella spp.
LPLLAGLIAAPFVVTGCTTT

SEQ ID NO: 25975 - protein, 39 aa, Brucella spp.
HPKLKNAMFFHTAGLTFPYRNMHYVLVAGGNSFYEKRNR

SEQ ID NO: 25976 - protein, 28 aa, Brucella spp.
RESVPDLLILDWMLPGVSGIELCRRLRQ

SEQ ID NO: 25977 - protein, 26 aa, Brucella spp.
GPTEFRLLEYFMMSPGRVFSRSQLLD

SEQ ID NO: 25978 - protein, 17 aa, Brucella spp.
DKAVMIIAKRQPMAVDL

SEQ ID NO: 25979 - protein, 18 aa, Brucella spp.
AVMIIAKRQPMAVDLREI

SEQ ID NO: 25980 - protein, 31 aa, Brucella spp.
DDEIDAMYTSLFRELLTYMMEDPRNISACTH

SEQ ID NO: 25981 - protein, 25 aa, Brucella spp.
TNIAETVYYIVTGLQMPAERPKEDL

SEQ ID NO: 25982 - protein, 24 aa, Brucella spp.
RGEKVCVFYGEKQALFDVDLDIPE

SEQ ID NO: 25983 - protein, 25 aa, Brucella spp.
LRARVGMVFQKPNPFPKSIYENVAY

SEQ ID NO: 25984 - protein, 18 aa, Brucella spp.
QQQRLCIARAIAVSPEVI

SEQ ID NO: 25985 - protein, 17 aa, Brucella spp.
RLCIARAIAVSPEVILM

SEQ ID NO: 25986 - protein, 17 aa, Brucella spp.
CIARAIAVSPEVILMDE

SEQ ID NO: 25987 - protein, 25 aa, Brucella spp.
LIDELRQNFTIVIVTHSMQQAARVS

SEQ ID NO: 25988 - protein, 18 aa, Brucella spp.
RRFRLYGILAIAVGVFFL

SEQ ID NO: 25989 - protein, 24 aa, Brucella spp.
LAIAVGVFFLCALLFSVFSKGYTA

SEQ ID NO: 25990 - protein, 21 aa, Brucella spp.
GYTAFWQTTLYLPVKLEQQVI

SEQ ID NO: 25991 - protein, 26 aa, Brucella spp.
ALVGSLYMMLIVLGLSLPIGVAASIY

SEQ ID NO: 25992 - protein, 17 aa, Brucella spp.
LVGGLVLTLMTLPTIII

SEQ ID NO: 25993 - protein, 29 aa, Brucella spp.
RTSGAIIVLLLFLAVMNIAAIILRRRFER

SEQ ID NO: 25994 - protein, 29 aa, Brucella spp.
HSRPHYHGWWVFLVSALPALLFLAIWAVG

SEQ ID NO: 25995 - protein, 26 aa, Brucella spp.
FQSVSPWEFFFGTVWDPRFAAAGSGG

SEQ ID NO: 25996 - protein, 31 aa, Brucella spp.
VAFALGITLFVLTLIMNIFALHIVRKYREQY

SEQ ID NO: 25997 - protein, 25 aa, Brucella spp.
GVGVFGLYFFENNADKLKVATVNGV

SEQ ID NO: 25998 - protein, 29 aa, Brucella spp.
GEYPVSRPLYFYVKKAHLGVIPGLKEYVE

SEQ ID NO: 25999 - protein, 27 aa, Brucella spp.
PGLKEYVEFFLNDQMIGPDGPLAEYGL

SEQ ID NO: 26000 - protein, 26 aa, Brucella spp.
LTEMDVILLRQDPPFDMNYITTTHLL

SEQ ID NO: 26001 - protein, 20 aa, Brucella spp.
PPFDMNYITTTHLLERIHPK

SEQ ID NO: 26002 - protein, 17 aa, Brucella spp.
PEKIFVTEFPDLMPETL

SEQ ID NO: 26003 - protein, 18 aa, Brucella spp.
KIFVTEFPDLMPETLITK

SEQ ID NO: 26004 - protein, 29 aa, Brucella spp.
LTSLLEMFGQLFREPFIAQRYLKDVRAGD

SEQ ID NO: 26005 - protein, 18 aa, Brucella spp.
FDEEIRFFKGWIDGPKAV

SEQ ID NO: 26006 - protein, 25 aa, Brucella spp.
KGQKFDCIISAVPMLNFPMDRRVEL

SEQ ID NO: 26007 - protein, 26 aa, Brucella spp.
HIPHGRPLMQITYGPLPPVPAGRGNY

SEQ ID NO: 26008 - protein, 24 aa, Brucella spp.
VQHYDFVVRNVPPAQLWVYRSPLV

SEQ ID NO: 26009 - protein, 22 aa, Brucella spp.
GTLFAVKRLIGRRYDDPMVTKD

SEQ ID NO: 26010 - protein, 25 aa, Brucella spp.
AGLEVLRIINEPTAAALAYGLDKSE

SEQ ID NO: 26011 - protein, 27 aa, Brucella spp.
FLGGEDFDIRLVEYLVAEFKKESGIDL

SEQ ID NO: 26012 - protein, 22 aa, Brucella spp.
QQTEINLPFITADQTGPKHLAI

SEQ ID NO: 26013 - protein, 28 aa, Brucella spp.
LQGDVKDVLLLDVTPLSLGIETLGGVFT

SEQ ID NO: 26014 - protein, 26 aa, Brucella spp.
AADNKLLGQFDLVGIPPAPRGVPQIE

SEQ ID NO: 26015 - protein, 21 aa, Brucella spp.
DRAAFRAFTIARVLTATRHPD

SEQ ID NO: 26016 - protein, 17 aa, Brucella spp.
SFAAYMGFNDPIIEIGL

SEQ ID NO: 26017 - protein, 20 aa, Brucella spp.
AAYMGFNDPIIEIGLTPNRA

SEQ ID NO: 26018 - protein, 27 aa, Brucella spp.
NGPSPKWMQQRLKAIGLRPINALVDIT

SEQ ID NO: 26019 - protein, 20 aa, Brucella spp.
AIGLRPINALVDITNYVTFD

SEQ ID NO: 26020 - protein, 18 aa, Brucella spp.
VDITNYVTFDQGRPLHVF

SEQ ID NO: 26021 - protein, 19 aa, Brucella spp.
VLIESALWDPRMIARTGRE

SEQ ID NO: 26022 - protein, 24 aa, Brucella spp.
PHTARVIDFPVTEVKRLTGLDVSY

SEQ ID NO: 26023 - protein, 21 aa, Brucella spp.
MSDMRPSLLPGLLAAAQRNAD

SEQ ID NO: 26024 - protein, 17 aa, Brucella spp.
EGAGRFWAGNAAPVGVF

SEQ ID NO: 26025 - protein, 17 aa, Brucella spp.
RFWAGNAAPVGVFDAKA

SEQ ID NO: 26026 - protein, 23 aa, Brucella spp.
AGGPEWLHPGRSGTLKLGPKVVL

SEQ ID NO: 26027 - protein, 22 aa, Brucella spp.
PALSLSLFQSLKRDYAFVVDAA

SEQ ID NO: 26028 - protein, 27 aa, Brucella spp.
SADKKLIVGVQVFDIFTGASLGEGKKS

SEQ ID NO: 26029 - protein, 23 aa, Brucella spp.
ANMKWVLEEFCKAFFEVPSVKMR

SEQ ID NO: 26030 - protein, 31 aa, Brucella spp.
FEVPSVKMRMRPSFFPFTEPSVEVDIQCDRS

SEQ ID NO: 26031 - protein, 20 aa, Brucella spp.
MGIGRIAMLKYGMPDLRAFF

SEQ ID NO: 26032 - protein, 24 aa, Brucella spp.
AKRLHSFISPFLPYPFLRSPKETN

SEQ ID NO: 26033 - protein, 27 aa, Brucella spp.
VAQARDVWLLFFQITAQARFSKTPHRA

SEQ ID NO: 26034 - protein, 27 aa, Brucella spp.
ELHRIVGLFRFTIAPLRLFRHVFLGGD

SEQ ID NO: 26035 - protein, 26 aa, Brucella spp.
NRKRSFRALWIQRINAAVREQGLTYG

SEQ ID NO: 26036 - protein, 24 aa, Brucella spp.
FAIGGVIVLLVIALIFVRSQSTGS

SEQ ID NO: 26037 - protein, 27 aa, Brucella spp.
RTFTDGLVFFVAYPFFEFVEYLQNSHI

SEQ ID NO: 26038 - protein, 25 aa, Brucella spp.
PNAEPPVCKIVDLGKLKYQNQKKAA

SEQ ID NO: 26039 - protein, 36 aa, Brucella spp.
TVSIDPAFVLPLVALFFLIRLFGPSLAVIAVLVLGM

SEQ ID NO: 26040 - protein, 29 aa, Brucella spp.
TSDGVLSFSWRIGMAPPPVINYLVAHEAA

SEQ ID NO: 26041 - protein, 17 aa, Brucella spp.
APPPVINYLVAHEAAHL

SEQ ID NO: 26042 - protein, 17 aa, Brucella spp.
PPVINYLVAHEAAHLIE

SEQ ID NO: 26043 - protein, 17 aa, Brucella spp.
INYLVAHEAAHLIEMNH

SEQ ID NO: 26044 - protein, 18 aa, Brucella spp.
IEMNHGPKFWKLCQELCP

SEQ ID NO: 26045 - protein, 22 aa, Brucella spp.
AKVLWDYHCIYDPLEGADIIIG

SEQ ID NO: 26046 - protein, 31 aa, Brucella spp.
AERASDLYLEGLAPWLIFTGRSGRGTDKLYK

SEQ ID NO: 26047 - protein, 27 aa, Brucella spp.
DGGATHIGFIFFPKSPRHITPDAAARL

SEQ ID NO: 26048 - protein, 22 aa, Brucella spp.
NGISFDWNLLAALDADIDYMLS

SEQ ID NO: 26049 - protein, 31 aa, Brucella spp.
GIFGGRFVAETLMPLILELQQAYETAKNDPE

SEQ ID NO: 26050 - protein, 25 aa, Brucella spp.
ERQKPNVFRMKLLGAEVKPVSAGNG

SEQ ID NO: 26051 - protein, 26 aa, Brucella spp.
GSNAIGLFHPFLDDASVKIVGVEAGG

SEQ ID NO: 26052 - protein, 18 aa, Brucella spp.
RVDYVPILDNEALDAFQL

SEQ ID NO: 26053 - protein, 17 aa, Brucella spp.
PILDNEALDAFQLCTRT

SEQ ID NO: 26054 - protein, 31 aa, Brucella spp.
LHQGEESLWLLLHWWLEGGIATRMLWQCELG

SEQ ID NO: 26055 - protein, 34 aa, Brucella spp.
KEDDTTPIVMMGYYNLIYIYGVERFLTDAKASGV

SEQ ID NO: 26056 - protein, 26 aa, Brucella spp.
IKAKDRLRFFFDNGEYTTLEAPKVPL

SEQ ID NO: 26057 - protein, 19 aa, Brucella spp.
EMLKEAGLPYIVVLTNPTT

SEQ ID NO: 26058 - protein, 33 aa, Brucella spp.
ANGGQHITVFEILTAVAFVLFSEHPADAVIMEV

SEQ ID NO: 26059 - protein, 17 aa, Brucella spp.
VLFSEHPADAVIMEVGL

SEQ ID NO: 26060 - protein, 26 aa, Brucella spp.
EERNARPLFLITGMINTKDPVGYFEA

SEQ ID NO: 26061 - protein, 17 aa, Brucella spp.
PPRILIGGSLYLAGEVL

SEQ ID NO: 26062 - protein, 17 aa, Brucella spp.
RILIGGSLYLAGEVLRD

SEQ ID NO: 26063 - protein, 30 aa, Brucella spp.
VKVLPDLVGEPFFILNADTFWVGDEAEPNL

SEQ ID NO: 26064 - protein, 19 aa, Brucella spp.
DDARMDILLMTARLDQETG

SEQ ID NO: 26065 - protein, 17 aa, Brucella spp.
MDILLMTARLDQETGYE

SEQ ID NO: 26066 - protein, 24 aa, Brucella spp.
PDHAPVAFYPDHVIAPFDRDAMMI

SEQ ID NO: 26067 - protein, 25 aa, Brucella spp.
PFDRDAMMIEVSLVGQWYAPRMMGR

SEQ ID NO: 26068 - protein, 34 aa, Brucella spp.
DSEKSLLLRDYHSPNLFWLAGAQGKDKIGIIDFQ

SEQ ID NO: 26069 - protein, 21 aa, Brucella spp.
AYLQHLPRIHDYLGRVLKHPV

SEQ ID NO: 26070 - protein, 24 aa, Brucella spp.
RVLKHPVMAPVAAWFKALGLMQEG

SEQ ID NO: 26071 - protein, 24 aa, Brucella spp.
SGSLHMTIQTAVLIETLKVLGAEV

SEQ ID NO: 26072 - protein, 33 aa, Brucella spp.
KGETLEEYWTYTDQIFQWPDGEPSNMILDDGGD

SEQ ID NO: 26073 - protein, 23 aa, Brucella spp.
DGGDATMYILIGARAEAGEDVLS

SEQ ID NO: 26074 - protein, 25 aa, Brucella spp.
TGVNRLYQLQKKGLLPFPAINVNDS

SEQ ID NO: 26075 - protein, 21 aa, Brucella spp.
KPQVDLIEFPDGKRLILLSEG

SEQ ID NO: 26076 - protein, 27 aa, Brucella spp.
IEFPDGKRLILLSEGRLLNLGNATGHP

SEQ ID NO: 26077 - protein, 25 aa, Brucella spp.
VGGTSIMGLMMLAASPGCCIEVSAS

SEQ ID NO: 26078 - protein, 27 aa, Brucella spp.
IEVIAGVNLPMLIKLSSVRISGDIKTA

SEQ ID NO: 26079 - protein, 25 aa, Brucella spp.
RGAGLFRIPYRVATPLDLVVLLVNG

SEQ ID NO: 26080 - protein, 26 aa, Brucella spp.
YPGKERWIFEEVSLPRLLLPALSANG

SEQ ID NO: 26081 - protein, 51 aa, Brucella spp.
ARRQRSVFLRRFLSPLRKFLGQYLFSSLTRRILFLNLAALAVLVSGILYMN

SEQ ID NO: 26082 - protein, 27 aa, Brucella spp.
WERIGSWLSRLFYGGGLPLYQEQPGGN

SEQ ID NO: 26083 - protein, 24 aa, Brucella spp.
ERMAVFRVFGVVSAVMVILSLFLA

SEQ ID NO: 26084 - protein, 23 aa, Brucella spp.
VSAVMVILSLFLASTIANPLRKL

SEQ ID NO: 26085 - protein, 18 aa, Brucella spp.
LRQKSDLPVIFLTSKDDE

SEQ ID NO: 26086 - protein, 27 aa, Brucella spp.
PVTLTVTEFLILHSLAQRPGVVKSRDA

SEQ ID NO: 26087 - protein, 31 aa, Brucella spp.
ARVITEYAWHSLFIRNLLIRPSQEALASYVP

SEQ ID NO: 26088 - protein, 24 aa, Brucella spp.
KKSVFTALNYILPAKGVMPMHCSA

SEQ ID NO: 26089 - protein, 25 aa, Brucella spp.
GQPKNIIMLTADAFGVMPPIAKLTP

SEQ ID NO: 26090 - protein, 24 aa, Brucella spp.
TPAQAMYHFLSGYTAKVAATEKGV

SEQ ID NO: 26091 - protein, 17 aa, Brucella spp.
FHAARSGLPEDILSRLF

SEQ ID NO: 26092 - protein, 24 aa, Brucella spp.
SGLPEDILSRLFKLAGQKGTKDGD

SEQ ID NO: 26093 - protein, 24 aa, Brucella spp.
EDARERLLALIAKAAEPPPPPRKK

SEQ ID NO: 26094 - protein, 25 aa, Brucella spp.
LDEVRRIYLSLSRLLYAHVEASQLL

SEQ ID NO: 26095 - protein, 23 aa, Brucella spp.
IVDKPDILIFEGINVLQVRDLPE

SEQ ID NO: 26096 - protein, 28 aa, Brucella spp.
GKMVPFVSDFFDFSIYIDADPRLIHKWY

SEQ ID NO: 26097 - protein, 27 aa, Brucella spp.
IDADPRLIHKWYIDRFMRLRETAFRDP

SEQ ID NO: 26098 - protein, 25 aa, Brucella spp.
ARTAEQCFMPLTVGGGVRQVADIRK

SEQ ID NO: 26099 - protein, 18 aa, Brucella spp.
ENDHWEIFTHGGRQPTGI

SEQ ID NO: 26100 - protein, 17 aa, Brucella spp.
HWEIFTHGGRQPTGIDA

SEQ ID NO: 26101 - protein, 17 aa, Brucella spp.
EIFTHGGRQPTGIDAVE

SEQ ID NO: 26102 - protein, 26 aa, Brucella spp.
AVLAASIFHFGTYTIGEAKRYMAEAG

SEQ ID NO: 26103 - protein, 26 aa, Brucella spp.
AFEDQGFEWLHVVDLNGAFAGESVNG

SEQ ID NO: 26104 - protein, 34 aa, Brucella spp.
IRTLAHIENWLSRGLRRVILGTVAVRDPALVMEA

SEQ ID NO: 26105 - protein, 25 aa, Brucella spp.
VLKKARPFLGICVGMQLMSERGLEK

SEQ ID NO: 26106 - protein, 24 aa, Brucella spp.
DDGLHAYFVHSYMLDAKNASDVLA

SEQ ID NO: 26107 - protein, 36 aa, Brucella spp.
VRDGFSILALVFPFVWLLMQRLWFEAFAVLGITILL

SEQ ID NO: 26108 - protein, 32 aa, Brucella spp.
KDWRTDRYLRKLEAMMLVADSKVTLALTGTGD

SEQ ID NO: 26109 - protein, 19 aa, Brucella spp.
EVMPKNILMIGPTGVGKTE

SEQ ID NO: 26110 - protein, 25 aa, Brucella spp.
GRDVEQIIRDLVEIAITLVREKRRE

SEQ ID NO: 26111 - protein, 27 aa, Brucella spp.
YGPVKTDHILFITSGAFHVSKPSDLLP

SEQ ID NO: 26112 - protein, 17 aa, Brucella spp.
IKQYIALMETEEVKLEF

SEQ ID NO: 26113 - protein, 27 aa, Brucella spp.
PNAKPLRTFAGIALAFFLASQSAHAVT

SEQ ID NO: 26114 - protein, 18 aa, Brucella spp.
ALAFFLASQSAHAVTVVP

SEQ ID NO: 26115 - protein, 27 aa, Brucella spp.
PNNRFSAVFFQPFYAGQTFGLGQINPL

SEQ ID NO: 26116 - protein, 17 aa, Brucella spp.
AVYKTIMDPDLTLPYIA

SEQ ID NO: 26117 - protein, 21 aa, Brucella spp.
KTIMDPDLTLPYIAATLKQSI

SEQ ID NO: 26118 - protein, 19 aa, Brucella spp.
MLPQENYYGWLVNSKLDEL

SEQ ID NO: 26119 - protein, 32 aa, Brucella spp.
GILRQAVPHWFSTPLFRLLVSAYEDAARHHGG

SEQ ID NO: 26120 - protein, 17 aa, Brucella spp.
ARFKVPFLRKHADLVKV

SEQ ID NO: 26121 - protein, 32 aa, Brucella spp.
PDRADELIWKNRSYIFFREAPVDDPAAGPVAA

SEQ ID NO: 26122 - protein, 27 aa, Brucella spp.
SMAVDRLLHTFGTPFYVSAPTLCAFGG

SEQ ID NO: 26123 - protein, 26 aa, Brucella spp.
TSAVGILLFIPFVRDIVWEKFVRGRM

SEQ ID NO: 26124 - protein, 19 aa, Brucella spp.
DAVHRLYSGRAAPLIEATF

SEQ ID NO: 26125 - protein, 27 aa, Brucella spp.
KSGAAIALVDIPLLFETGAEKRVDKVV

SEQ ID NO: 26126 - protein, 26 aa, Brucella spp.
IAAIIFPIVFVLGFFAIFWLRSKGQN

SEQ ID NO: 26127 - protein, 34 aa, Brucella spp.
PEKRRIGYVFQDARLFAYMSVKRNLTYARWAGHR

SEQ ID NO: 26128 - protein, 17 aa, Brucella spp.
SFDEVVALLGIGHLLDR

SEQ ID NO: 26129 - protein, 24 aa, Brucella spp.
LLSDPALLLLDEPLSSLDHARRQE

SEQ ID NO: 26130 - protein, 18 aa, Brucella spp.
EILPFIERLRDESHVPIV

SEQ ID NO: 26131 - protein, 27 aa, Brucella spp.
IIIALPLAFLVGWLLARFHFPGKSLVQ

SEQ ID NO: 26132 - protein, 26 aa, Brucella spp.
VTMPLVLPPVVTGYLLLILFGARGPL

SEQ ID NO: 26133 - protein, 25 aa, Brucella spp.
GASRFTAFFTVILPPLLPGILAGAV

SEQ ID NO: 26134 - protein, 26 aa, Brucella spp.
EQGAPAQIFISADLDWMDYVEKAGLI

SEQ ID NO: 26135 - protein, 25 aa, Brucella spp.
PADSHAPILYPAALLKKNESDAART

SEQ ID NO: 26136 - protein, 28 aa, Brucella spp.
FISQRKDIVLVLLDLTMPDMDGLTVLSR

SEQ ID NO: 26137 - protein, 30 aa, Brucella spp.
RLGAADFMIKPLIFERVQVSVANVLKLDAL

SEQ ID NO: 26138 - protein, 34 aa, Brucella spp.
PLVDFVHMGRFHAGLYHLLGSFSIAMPPLRERVE

SEQ ID NO: 26139 - protein, 25 aa, Brucella spp.
TDASTPLIFFTLELNCIDDTVLEKA

SEQ ID NO: 26140 - protein, 18 aa, Brucella spp.
IARKFFDRNWIDAPVRPG

SEQ ID NO: 26141 - protein, 17 aa, Brucella spp.
KFFDRNWIDAPVRPGKA

SEQ ID NO: 26142 - protein, 18 aa, Brucella spp.
VFGEMLTFRLLLERTRDK

SEQ ID NO: 26143 - protein, 38 aa, Brucella spp.
RLNPGYETFWTYIPHFIHSPFYVYAYAFGDCLVNSLYA

SEQ ID NO: 26144 - protein, 27 aa, Brucella spp.
AQWGGDPLILFNMLAKRQPVRYATYCD

SEQ ID NO: 26145 - protein, 22 aa, Brucella spp.
SGLHLRAVFAALFPCGSITGAP

SEQ ID NO: 26146 - protein, 23 aa, Brucella spp.
AEGNYLYLSPQLVEINMRSIVRG

SEQ ID NO: 26147 - protein, 33 aa, Brucella spp.
LSDRRVIEWSRLIWYPILYGIVLNTRPRRSGRL

SEQ ID NO: 26148 - protein, 25 aa, Brucella spp.
QGCERIVIFPLYPQYSATTTATVND

SEQ ID NO: 26149 - protein, 19 aa, Brucella spp.
LILVALVLAALIASIKTVP

SEQ ID NO: 26150 - protein, 27 aa, Brucella spp.
LNPGLNLIVPFFDRVGARLNMMEQVLD

SEQ ID NO: 26151 - protein, 22 aa, Brucella spp.
AKLQYAILNLTMTNIRTVMGSM

SEQ ID NO: 26152 - protein, 24 aa, Brucella spp.
AKNQKIVLMPLEASSLIGSLGGIG

SEQ ID NO: 26153 - protein, 20 aa, Brucella spp.
KAVFPVAGLGTRFLPATKSI

SEQ ID NO: 26154 - protein, 23 aa, Brucella spp.
LVGNEPFALLLPDMVMQSKKGCL

SEQ ID NO: 26155 - protein, 31 aa, Brucella spp.
TAPSNLYINGRYILQPEIFGLLSKQEKGAGN

SEQ ID NO: 26156 - protein, 23 aa, Brucella spp.
LRAAFSCYYAGNFTGGFKTKPGS

SEQ ID NO: 26157 - protein, 26 aa, Brucella spp.
DVTTKPIVVVPMIRKTPDAAAAVAAP

SEQ ID NO: 26158 - protein, 24 aa, Brucella spp.
GPSILLIYAITGFMLFFVMRALGE

SEQ ID NO: 26159 - protein, 18 aa, Brucella spp.
GFMLFFVMRALGEILLSN

SEQ ID NO: 26160 - protein, 17 aa, Brucella spp.
LFFVMRALGEILLSNLQ

SEQ ID NO: 26161 - protein, 24 aa, Brucella spp.
VPGYVSFWFPHLAPWIPALGLITI

SEQ ID NO: 26162 - protein, 24 aa, Brucella spp.
NFGEIEFWFALIKIITIIGLIITG

SEQ ID NO: 26163 - protein, 23 aa, Brucella spp.
NIPIRIVLFYIGALFVIITVTPW

SEQ ID NO: 26164 - protein, 28 aa, Brucella spp.
TTISALLFIFIWSIILVSYLQYRRKHPE

SEQ ID NO: 26165 - protein, 28 aa, Brucella spp.
GRASVVMVFIFFAFVLWALTQEPDTLAA

SEQ ID NO: 26166 - protein, 26 aa, Brucella spp.
AMKVTPLWFVLLGIAYWVMKLKQKQS

SEQ ID NO: 26167 - protein, 24 aa, Brucella spp.
PASDRIRHFREFTIPMTDGEVQKQ

SEQ ID NO: 26168 - protein, 26 aa, Brucella spp.
EKEDKLSVWPYWATKMRTSSSQAEGA

SEQ ID NO: 26169 - protein, 32 aa, Brucella spp.
RPIAGTEFFIKADLAFIAIGFAGPVEDSVVKE

SEQ ID NO: 26170 - protein, 26 aa, Brucella spp.
PGHYGVGYIFMPRDPDLRAHAEEIVR

SEQ ID NO: 26171 - protein, 26 aa, Brucella spp.
IAATEPFHMQVFIGRSPMLETDDDFE

SEQ ID NO: 26172 - protein, 26 aa, Brucella spp.
DDFERRLFVLRKVISNRIYQENDGDD

SEQ ID NO: 26173 - protein, 28 aa, Brucella spp.
ARTVVYKGMFLAYQVGAYYLDLKDPRFE

SEQ ID NO: 26174 - protein, 23 aa, Brucella spp.
STNTFPSWRLAHPYRMVAHNGEI

SEQ ID NO: 26175 - protein, 26 aa, Brucella spp.
YSLAHAMMMLIPEAWSGNKLMSDERR

SEQ ID NO: 26176 - protein, 26 aa, Brucella spp.
SDERRAFYEYHAALMEPWDGPAAVAF

SEQ ID NO: 26177 - protein, 29 aa, Brucella spp.
VDEKKIVRKWRLQPGRMLLIDMEEGRIIS

SEQ ID NO: 26178 - protein, 24 aa, Brucella spp.
AQKHPYKQWLANTQLILEDLNPVE

SEQ ID NO: 26179 - protein, 26 aa, Brucella spp.
MSDKSKLLYTYFKQNFAQVTNPPIDP

SEQ ID NO: 26180 - protein, 21 aa, Brucella spp.
PIREELVMSLVSFIGPRPNIF

SEQ ID NO: 26181 - protein, 24 aa, Brucella spp.
VRTDFVDKFFFGTATTIEGVGLDE

SEQ ID NO: 26182 - protein, 31 aa, Brucella spp.
FKGTPEHVINFFFYLAEEVRALLAQMGFTRL

SEQ ID NO: 26183 - protein, 19 aa, Brucella spp.
ELFEREVAVFFVGTGTAAN

SEQ ID NO: 26184 - protein, 18 aa, Brucella spp.
RELKRFNPAFVHAGQPMA

SEQ ID NO: 26185 - protein, 24 aa, Brucella spp.
DLTPAEMTWKLGVDIVSFGGTKNG

SEQ ID NO: 26186 - protein, 26 aa, Brucella spp.
GCWCAEALVFMDPARAKDLPFIRKRA

SEQ ID NO: 26187 - protein, 25 aa, Brucella spp.
ARAKDLPFIRKRAAQLFSKTRFVAA

SEQ ID NO: 26188 - protein, 19 aa, Brucella spp.
LYRSTVGFDRLFTMLDSLA

SEQ ID NO: 26189 - protein, 25 aa, Brucella spp.
TVGFDRLFTMLDSLASPEGNQSYPP

SEQ ID NO: 26190 - protein, 19 aa, Brucella spp.
AFERRFQLADFVEVSGASL

SEQ ID NO: 26191 - protein, 21 aa, Brucella spp.
GDMRLERDTYFVRATRPSGRR

SEQ ID NO: 26192 - protein, 24 aa, Brucella spp.
PSGRRVVVMVDAYNGNIIGERRAG

SEQ ID NO: 26193 - protein, 35 aa, Brucella spp.
LDHFLTGIVLPDCPPPFFILAHSAGALVALSSLER

SEQ ID NO: 26194 - protein, 18 aa, Brucella spp.
RRITAALRWIGLGRIYAA

SEQ ID NO: 26195 - protein, 24 aa, Brucella spp.
LGGPTVRWVWSALETAWRINQPDF

SEQ ID NO: 26196 - protein, 24 aa, Brucella spp.
RINQPDFYKSPIAPVLIIAAGADR

SEQ ID NO: 26197 - protein, 26 aa, Brucella spp.
EIDPDLKIMFITGFAAVALNPDSDAP

SEQ ID NO: 26198 - protein, 29 aa, Brucella spp.
DYAIAAAVFYTVVILLSARLLTGKAVTGL

SEQ ID NO: 26199 - protein, 22 aa, Brucella spp.
SRERLLRLARMTTLGQLTSSIA

SEQ ID NO: 26200 - protein, 20 aa, Brucella spp.
RLFDAFWTTKKGGFGLGLTI

SEQ ID NO: 26201 - protein, 27 aa, Brucella spp.
HAAVATVFIIAVNALLRPLVQVLEFQA

SEQ ID NO: 26202 - protein, 19 aa, Brucella spp.
ALLRPLVQVLEFQAMRRGA

SEQ ID NO: 26203 - protein, 20 aa, Brucella spp.
AFKNPFIMVLVVLGAISAFT

SEQ ID NO: 26204 - protein, 32 aa, Brucella spp.
GINSVSWLLIRFMLIMVPVVFLINGFTKGNWV

SEQ ID NO: 26205 - protein, 33 aa, Brucella spp.
VLVASAFIPFLPMLAIHLLIQNLMYDISQLALP

SEQ ID NO: 26206 - protein, 26 aa, Brucella spp.
ARNIGRFMIWIGPTSSIFDITTFALM

SEQ ID NO: 26207 - protein, 27 aa, Brucella spp.
IFDITTFALMWYVFSANSPQMQSLFQS

SEQ ID NO: 26208 - protein, 19 aa, Brucella spp.
MLMSALIIALGIYIPFSPI

SEQ ID NO: 26209 - protein, 31 aa, Brucella spp.
GEMVGLVPLPWAYFPWLAATLVSYCLVAQGM

SEQ ID NO: 26210 - protein, 27 aa, Brucella spp.
RLLTRLTHWIWAASIFFLLLSGLQIFN

SEQ ID NO: 26211 - protein, 27 aa, Brucella spp.
TGRVVHFFFAWVLVATLLLWFTSSLFN

SEQ ID NO: 26212 - protein, 25 aa, Brucella spp.
PLQKLSYFLVLFGLFPLIVATGLAM

SEQ ID NO: 26213 - protein, 17 aa, Brucella spp.
ARTLHFVAMLLLVAFFI

SEQ ID NO: 26214 - protein, 17 aa, Brucella spp.
TLHFVAMLLLVAFFIVH

SEQ ID NO: 26215 - protein, 21 aa, Brucella spp.
RRFLTFTGMAGSAVLLSGCDA

SEQ ID NO: 26216 - protein, 22 aa, Brucella spp.
AKWTGVPLGHILALAKPKAGAH

SEQ ID NO: 26217 - protein, 24 aa, Brucella spp.
TPQGPDLFYGSIDLIDAQHPQTIL

SEQ ID NO: 26218 - protein, 20 aa, Brucella spp.
GWMPLTLPQLDFWEEFSFHP

SEQ ID NO: 26219 - protein, 26 aa, Brucella spp.
RIGARQYIWYIRAHHIIIDGYGLALI

SEQ ID NO: 26220 - protein, 26 aa, Brucella spp.
TDIGWPDLLVLLSGLYLSRMLPMQGE

SEQ ID NO: 26221 - protein, 25 aa, Brucella spp.
EDEGLTLWLPFMSRWGSVGAHMPGL

SEQ ID NO: 26222 - protein, 26 aa, Brucella spp.
LVSGSRFFFSPLINVLPFSTPQFAGC

SEQ ID NO: 26223 - protein, 35 aa, Brucella spp.
GDTALVQLPNIAEFYIVFFALMKAGIAPVNALFSH

SEQ ID NO: 26224 - protein, 18 aa, Brucella spp.
HGVNMVALVPPAVALWLQ

SEQ ID NO: 26225 - protein, 20 aa, Brucella spp.
NMVALVPPAVALWLQAAPDH

SEQ ID NO: 26226 - protein, 25 aa, Brucella spp.
PDLKPPVLRRHLLALGVAEYKLPDR

SEQ ID NO: 26227 - protein, 24 aa, Brucella spp.
YKLPDRIRLIETMPLTAVGKIDKK

SEQ ID NO: 26228 - protein, 22 aa, Brucella spp.
DAPFRLIRLDITDAAEVRAVSD

SEQ ID NO: 26229 - protein, 28 aa, Brucella spp.
DVNASGPFHLLSQWVPVFRDQRHGAIVN

SEQ ID NO: 26230 - protein, 22 aa, Brucella spp.
GLPEQFKLGIPLGKIAIPDDIA

SEQ ID NO: 26231 - protein, 33 aa, Brucella spp.
EAAGRKLLERGPKIVILKLGSRGALLVTADEVK

SEQ ID NO: 26232 - protein, 21 aa, Brucella spp.
SPILVRPHPQTSGRYMIVFGH

SEQ ID NO: 26233 - protein, 24 aa, Brucella spp.
PQTSGRYMIVFGHRRARVARELGI

SEQ ID NO: 26234 - protein, 24 aa, Brucella spp.
ARANLSFIERVLLRSTPGSHGFRA

SEQ ID NO: 26235 - protein, 36 aa, Brucella spp.
RPDCRLPDLSKMLTIPKAIPEEILLAIGPAKGIGRD

SEQ ID NO: 26236 - protein, 24 aa, Brucella spp.
GIGRDRWLELRKLVEMPGKKAAAA

SEQ ID NO: 26237 - protein, 36 aa, Brucella spp.
LITVHPQMLDLMSMSQFLLMLGDILKTVRQAGGAVH

SEQ ID NO: 26238 - protein, 29 aa, Brucella spp.
QAGGAVHLDWFRYLITRYEPTDVPQAQMV

SEQ ID NO: 26239 - protein, 28 aa, Brucella spp.
YGLKDGFDWLLMLHGTSGHNYKNGDGTE

SEQ ID NO: 26240 - protein, 30 aa, Brucella spp.
RTDATDMWDPEVQFYYNRNDYWRNDYQNRT

SEQ ID NO: 26241 - protein, 26 aa, Brucella spp.
FAGASRTWLGYVLGDYGYVHARNNAF

SEQ ID NO: 26242 - protein, 30 aa, Brucella spp.
RSRGFTLNARYIWNYTTIGATFTKAKVTAG

SEQ ID NO: 26243 - protein, 26 aa, Brucella spp.
PNSGSFMPIGDMATLFIDQEIPDYNM

SEQ ID NO: 26244 - protein, 28 aa, Brucella spp.
SLIEPWVQFFRMIPPLAVIPLAIVTLGI

SEQ ID NO: 26245 - protein, 22 aa, Brucella spp.
SPKIFVIFLASFLSSVVATYQG

SEQ ID NO: 26246 - protein, 17 aa, Brucella spp.
VMRYGGFLALDRLNLDI

SEQ ID NO: 26247 - protein, 32 aa, Brucella spp.
PGPERGVIFQQYALFPWLTVRQNVEFGLTDFA

SEQ ID NO: 26248 - protein, 22 aa, Brucella spp.
MSLALTFLPSVALADNIPVRVG

SEQ ID NO: 26249 - protein, 22 aa, Brucella spp.
TSGDMLLRLALGKAGMKLDDVQ

SEQ ID NO: 26250 - protein, 25 aa, Brucella spp.
QIDAAGIWYPLIGTIKEHVPGMVEL

SEQ ID NO: 26251 - protein, 24 aa, Brucella spp.
FGERHGCWHWYTGFNEVMNCGKGG

SEQ ID NO: 26252 - protein, 28 aa, Brucella spp.
ARNKSRKWFLHVNLWDPHTPYRVPEEWG

SEQ ID NO: 26253 - protein, 26 aa, Brucella spp.
EFTCNVPLIIRWPGQAPGVNHGLHYH

SEQ ID NO: 26254 - protein, 26 aa, Brucella spp.
GVNHGLHYHFDWPATLIDGLGGKVPS

SEQ ID NO: 26255 - protein, 26 aa, Brucella spp.
RHQNEDWLMLRTWHDGLKDFGPVTLF

SEQ ID NO: 26256 - protein, 25 aa, Brucella spp.
AGVAIFIVLPVLRVALMLFQFAQAR

SEQ ID NO: 26257 - protein, 22 aa, Brucella spp.
VPGQWIIANQWGADMITALNSE

SEQ ID NO: 26258 - protein, 26 aa, Brucella spp.
SLPLIEPSFMFGLSGDELLALRDEYR

SEQ ID NO: 26259 - protein, 19 aa, Brucella spp.
RHVRPNFTKIFLDGVPGAR

SEQ ID NO: 26260 - protein, 29 aa, Brucella spp.
LSVVADLSPMIWYPTTFLEGHKEAMGDER

SEQ ID NO: 26261 - protein, 24 aa, Brucella spp.
DERATRFWPIADLHKSGALLAGGS

SEQ ID NO: 26262 - protein, 17 aa, Brucella spp.
GSDWPVIPVPDPWTGIE

SEQ ID NO: 26263 - protein, 26 aa, Brucella spp.
IDLATAIRIFTLNSAIAMGIGAETGS

SEQ ID NO: 26264 - protein, 25 aa, Brucella spp.
SLGLDLPWWAWTYIGIAAVAVLGYR

SEQ ID NO: 26265 - protein, 30 aa, Brucella spp.
PRATYISVLIIGIFYMLTAWLMVNGAGAGK

SEQ ID NO: 26266 - protein, 28 aa, Brucella spp.
LAERYVGHWIIPVMNLLFVTSLFAGVVA

SEQ ID NO: 26267 - protein, 28 aa, Brucella spp.
NVGTLAIMLLMTFTAFAIIAFFARRPGL

SEQ ID NO: 26268 - protein, 33 aa, Brucella spp.
LDLFYGVEFRKRFPLIELFDVIVDATYTKILKP

SEQ ID NO: 26269 - protein, 30 aa, Brucella spp.
IFATVTEFLAPLFATPHFALTLEIREIDPQ

SEQ ID NO: 26270 - protein, 34 aa, Brucella spp.
PIGPVGVITPWNTPFMLSTWKIAPALAAGCTVVH

SEQ ID NO: 26271 - protein, 20 aa, Brucella spp.
YGLTGYLWTNDVTRAFRFTD

SEQ ID NO: 26272 - protein, 17 aa, Brucella spp.
YLWTNDVTRAFRFTDAL

SEQ ID NO: 26273 - protein, 25 aa, Brucella spp.
DGGDWSFDFYMETKNIAFANAAHAI

SEQ ID NO: 26274 - protein, 36 aa, Brucella spp.
KGPRLHHTAFWVPTPLNIIDLLDLMSTTGWLANIER

SEQ ID NO: 26275 - protein, 25 aa, Brucella spp.
HGISNAFFLYVRDPDGHRIEIYCSD

SEQ ID NO: 26276 - protein, 31 aa, Brucella spp.
QDRTSRMIFSFRKIINYVSTFTTLVPGDVIV

SEQ ID NO: 26277 - protein, 24 aa, Brucella spp.
QGRAQIGLWQALANPYTVEICAGA

SEQ ID NO: 26278 - protein, 21 aa, Brucella spp.
AGYDWLLLDGEHAPNDVPLLV

SEQ ID NO: 26279 - protein, 30 aa, Brucella spp.
PVGETWIVKQLLDIGAQTLLIPMIESREQA

SEQ ID NO: 26280 - protein, 24 aa, Brucella spp.
GDLSLARHYLDLGATFVAIGNDVT

SEQ ID NO: 26281 - protein, 24 aa, Brucella spp.
QGVDAIVIVPMNSKVFDAVVADAK

SEQ ID NO: 26282 - protein, 30 aa, Brucella spp.
ASGIKVLSYDRLILNADIDAYISFDNERVG

SEQ ID NO: 26283 - protein, 20 aa, Brucella spp.
KDNIDIYIKDGFYTKEQIEG

SEQ ID NO: 26284 - protein, 27 aa, Brucella spp.
SLSGQMAEILMPLLAAKMEHEAVAEFA

SEQ ID NO: 26285 - protein, 23 aa, Brucella spp.
SFGERMLETRIAPLLEELKAAVK

SEQ ID NO: 26286 - protein, 19 aa, Brucella spp.
LLVLMASLSFAGVAGGTAC

SEQ ID NO: 26287 - protein, 24 aa, Brucella spp.
ARAQPEMRPLPVLEPYKLVRSLRM

SEQ ID NO: 26288 - protein, 29 aa, Brucella spp.
VWDKPENIYAAIIYLFNGGNPEAVRKVLA

SEQ ID NO: 26289 - protein, 28 aa, Brucella spp.
IGSADPLLQYTLYLQIARGALVDGQTER

SEQ ID NO: 26290 - protein, 24 aa, Brucella spp.
GGSDPATLFGALLEKPHGKVDASG

SEQ ID NO: 26291 - protein, 30 aa, Brucella spp.
GSGQKPVAVFGLPQNLLSLASALPGQQHGE

SEQ ID NO: 26292 - protein, 17 aa, Brucella spp.
DEKRPLRELPRVKAAQT

SEQ ID NO: 26293 - protein, 18 aa, Brucella spp.
PLRELPRVKAAQTNGDLA

SEQ ID NO: 26294 - protein, 28 aa, Brucella spp.
SFGTVKTLQIRLDPVELGAVTARIRVAG

SEQ ID NO: 26295 - protein, 26 aa, Brucella spp.
MRGDNDMVIFAENGVTLFETTARKVT

SEQ ID NO: 26296 - protein, 35 aa, Brucella spp.
GRLSGLLQLRDQIAPQYQMQLDEIARGLVTVFAES

SEQ ID NO: 26297 - protein, 23 aa, Brucella spp.
SPDQTGLFSWSGSPAIPGAGLSA

SEQ ID NO: 26298 - protein, 23 aa, Brucella spp.
IEVSVPFIASEGGSALLLRDGGA

SEQ ID NO: 26299 - protein, 26 aa, Brucella spp.
GVDIDTEMALLLDLEHSYQASSRVLT

SEQ ID NO: 26300 - protein, 17 aa, Brucella spp.
KSARSMLDSVTGLLNTS

SEQ ID NO: 26301 - protein, 19 aa, Brucella spp.
MLDSVTGLLNTSFNGEYIF

SEQ ID NO: 26302 - protein, 24 aa, Brucella spp.
GLLNTSFNGEYIFAGVNTDVKPIS

SEQ ID NO: 26303 - protein, 21 aa, Brucella spp.
VRQAFQDHFGFAMDDPQVANI

SEQ ID NO: 26304 - protein, 23 aa, Brucella spp.
KERERMLFDRTIAMLEAARANGA

SEQ ID NO: 26305 - protein, 24 aa, Brucella spp.
KELRAAIISIGIFVLKEIERIRQG

SEQ ID NO: 26306 - protein, 28 aa, Brucella spp.
NKASVDYDSFLKLLVTQMQNQDPTQPMD

SEQ ID NO: 26307 - protein, 25 aa, Brucella spp.
IGILAHIYFWALQFMANMMAMAVGY

SEQ ID NO: 26308 - protein, 24 aa, Brucella spp.
VTFSALFLFFVTDMHLEIFRALLN

SEQ ID NO: 26309 - protein, 26 aa, Brucella spp.
LGGGLLVVYFILPELLRFFTHETATQ

SEQ ID NO: 26310 - protein, 20 aa, Brucella spp.
LWICAVALGSLFLAVNRDVS

SEQ ID NO: 26311 - protein, 27 aa, Brucella spp.
KKLTVPLEYFISDEIFHKFYGSYSDTK

SEQ ID NO: 26312 - protein, 24 aa, Brucella spp.
LVLMAFMTWVRVDLLSFLFGDILA

SEQ ID NO: 26313 - protein, 21 aa, Brucella spp.
LILAVLAWLWRPLLAATVSED

SEQ ID NO: 26314 - protein, 28 aa, Brucella spp.
NPALSRIIFMLLLAIVIAIAMKIVGILL

SEQ ID NO: 26315 - protein, 17 aa, Brucella spp.
SHKPGLRIGYVPQKINI

SEQ ID NO: 26316 - protein, 21 aa, Brucella spp.
KPGLRIGYVPQKINIDRTLPL

SEQ ID NO: 26317 - protein, 19 aa, Brucella spp.
INIDRTLPLSVERLMTLTG

SEQ ID NO: 26318 - protein, 27 aa, Brucella spp.
RTLPLSVERLMTLTGPLPRKEIDAALE

SEQ ID NO: 26319 - protein, 30 aa, Brucella spp.
DDTSCGVLLISHDLHLVMAATDRVICLNGH

SEQ ID NO: 26320 - protein, 22 aa, Brucella spp.
SPEYVRLFGSRAVGPLAVYEHH

SEQ ID NO: 26321 - protein, 25 aa, Brucella spp.
AIEHAKVIFWAGPSMETFLDKPIDT

SEQ ID NO: 26322 - protein, 27 aa, Brucella spp.
HHHGEYDLHFWLDPQNGKILAADIAKT

SEQ ID NO: 26323 - protein, 27 aa, Brucella spp.
KPVKDKPFIVFHDAYQYFENRFGMKAA

SEQ ID NO: 26324 - protein, 25 aa, Brucella spp.
TMYCGHFFCHVLHQEYLVKKGEDCE

SEQ ID NO: 26325 - protein, 17 aa, Brucella spp.
GGDLFVHTMATLGPMAR

SEQ ID NO: 26326 - protein, 25 aa, Brucella spp.
RDIEDLVLLLDVLAEPYSLSPFGQK

SEQ ID NO: 26327 - protein, 26 aa, Brucella spp.
FSSQALWEAWITLRSLVIYGSKRALW

SEQ ID NO: 26328 - protein, 34 aa, Brucella spp.
FAEYDALIMPTAQVWPFPADWRWPQHINGQPMDS

SEQ ID NO: 26329 - protein, 27 aa, Brucella spp.
QPMDSYHRWMEVVVPVSLIGLAALSVP

SEQ ID NO: 26330 - protein, 34 aa, Brucella spp.
KQVLFGMGCFWGAERLFWQVPGVYVTAVGYAGGI

SEQ ID NO: 26331 - protein, 26 aa, Brucella spp.
VVYDPKVVTLNELLALFWEEHDPTQG

SEQ ID NO: 26332 - protein, 26 aa, Brucella spp.
TSTASFRRLLKEISLLLCYEVTRNLE

SEQ ID NO: 26333 - protein, 17 aa, Brucella spp.
IEYYFKAPEDIVNRLVI

SEQ ID NO: 26334 - protein, 23 aa, Brucella spp.
APEDIVNRLVIVVDPMLATANSA

SEQ ID NO: 26335 - protein, 26 aa, Brucella spp.
ERGATNIRFLCLLAAPEGIERFTKAH

SEQ ID NO: 26336 - protein, 18 aa, Brucella spp.
RLMRAGWILTREGVISAL

SEQ ID NO: 26337 - protein, 17 aa, Brucella spp.
VLTLEWIDGIKMSDIPA

SEQ ID NO: 26338 - protein, 17 aa, Brucella spp.
EWIDGIKMSDIPALEAA

SEQ ID NO: 26339 - protein, 29 aa, Brucella spp.
LDKQQRRFLAEILYGFITRDYMRVAEVHF

SEQ ID NO: 26340 - protein, 27 aa, Brucella spp.
TISMAKLLTLLFEVTELFDMETRPELL

SEQ ID NO: 26341 - protein, 17 aa, Brucella spp.
SAYALLHFTRKTPELLQ

SEQ ID NO: 26342 - protein, 20 aa, Brucella spp.
ILLIIGGGIAAYKTPDLIRR

SEQ ID NO: 26343 - protein, 32 aa, Brucella spp.
DLASAVLLARKVPLLIAPAMNPAMWDNPATRR

SEQ ID NO: 26344 - protein, 23 aa, Brucella spp.
WPHILFVLSIVLGAIAAIHATMT

SEQ ID NO: 26345 - protein, 29 aa, Brucella spp.
FSIAQQHILIMTPYLLPDRELISALVTAA

SEQ ID NO: 26346 - protein, 17 aa, Brucella spp.
LERRHGLVPVPITATMP

SEQ ID NO: 26347 - protein, 23 aa, Brucella spp.
PAGPLRVIAAHLGLLKRSREQQA

SEQ ID NO: 26348 - protein, 20 aa, Brucella spp.
ADTLPTLLIGDLNEWRIGKR

SEQ ID NO: 26349 - protein, 18 aa, Brucella spp.
TLLIGDLNEWRIGKRSSL

SEQ ID NO: 26350 - protein, 26 aa, Brucella spp.
TAVPSFPSRFPVLALDRVLGAPDNLI

SEQ ID NO: 26351 - protein, 28 aa, Brucella spp.
LFEVPPSWRFTLYLCIGWPCTEDDTPLL

SEQ ID NO: 26352 - protein, 28 aa, Brucella spp.
KDTGARVWPYYLHTIQPHVLREETVLVA

SEQ ID NO: 26353 - protein, 22 aa, Brucella spp.
MGQTLIRTIQSIEGAKLVGAIE

SEQ ID NO: 26354 - protein, 26 aa, Brucella spp.
AITDDPLPVFAKAHGVLDFTSPAASV

SEQ ID NO: 26355 - protein, 20 aa, Brucella spp.
GNMSLGVNLLSVLVQKAAEA

SEQ ID NO: 26356 - protein, 25 aa, Brucella spp.
HAEDRSIFARGAIKAALWAHGKKPG

SEQ ID NO: 26357 - protein, 51 aa, Brucella spp.
NGALAYMMKPMIDKIFYEQNLALVWVICGALLTIFVLRGISGYVQAVELAK

SEQ ID NO: 26358 - protein, 25 aa, Brucella spp.
ARYQKRIFDHLMKLGLDFYNDTRSG

SEQ ID NO: 26359 - protein, 40 aa, Brucella spp.
SLVGLVGMMFYMDPVLSVAIFLIGPPLILAVAYISRRIRS

SEQ ID NO: 26360 - protein, 23 aa, Brucella spp.
PGATFAFITAMLLAYDPARRLAR

SEQ ID NO: 26361 - protein, 35 aa, Brucella spp.
LDLFATYLGRLAGDLALIFMAHGGVYLSGGIPVRI

SEQ ID NO: 26362 - protein, 33 aa, Brucella spp.
KAPNKAIMRDIPVRVITYQLAALTGLSAFARTP

SEQ ID NO: 26363 - protein, 28 aa, Brucella spp.
AEGTVEVLIFFIDPLSPLPHDVDVKALT

SEQ ID NO: 26364 - protein, 34 aa, Brucella spp.
FETPMLVCIMLIVGGFILLWVDQLNLRPRYHNVM

SEQ ID NO: 26365 - protein, 21 aa, Brucella spp.
GFALFGWWRLIVGSAGMAALI

SEQ ID NO: 26366 - protein, 19 aa, Brucella spp.
FFNRFANMARFSPFLPVIG

SEQ ID NO: 26367 - protein, 30 aa, Brucella spp.
KVIGRKRMIVSMPWWAARLQASILNLLPNP

SEQ ID NO: 26368 - protein, 31 aa, Brucella spp.
PLKAMLVDSWYDSYLGVIVLVRVIDGVLKKG

SEQ ID NO: 26369 - protein, 28 aa, Brucella spp.
SAALGFGFRCGFLGLLHLEIIQERLERE

SEQ ID NO: 26370 - protein, 19 aa, Brucella spp.
REFNLDLITTAPSVVYRLN

SEQ ID NO: 26371 - protein, 26 aa, Brucella spp.
YVGPRAMITYDLPLNEVVFDFYDRLK

SEQ ID NO: 26372 - protein, 20 aa, Brucella spp.
LPLNEVVFDFYDRLKSISKG

SEQ ID NO: 26373 - protein, 29 aa, Brucella spp.
CEKLKELIPQHMFKIPIQAAIGGRIVARE

SEQ ID NO: 26374 - protein, 19 aa, Brucella spp.
EFSVPILTAIIGHGYEVVA

SEQ ID NO: 26375 - protein, 30 aa, Brucella spp.
EADVAIVVAYGLLLPKAILDAPRLGCYNGH

SEQ ID NO: 26376 - protein, 25 aa, Brucella spp.
NGHASLLPRWRGAAPIQRAIMAGDA

SEQ ID NO: 26377 - protein, 28 aa, Brucella spp.
WGNALLAWLFTPITLLQLFFPGRFDVAT

SEQ ID NO: 26378 - protein, 27 aa, Brucella spp.
ALTALEKMLKLMGFSANRPVFSDDNTP

SEQ ID NO: 26379 - protein, 24 aa, Brucella spp.
SGNGPHLMFAGHTDVVPPGDEKDW

SEQ ID NO: 26380 - protein, 34 aa, Brucella spp.
ETPIKYELTWRERPSHVFLTHDEKLIGTLTASVE

SEQ ID NO: 26381 - protein, 24 aa, Brucella spp.
TSDARFIKDYCPVVEFGLTGQTMH

SEQ ID NO: 26382 - protein, 35 aa, Brucella spp.
QADGNWHVNQWLKKAVLLSFRLNPMEVIKGGPGQS

SEQ ID NO: 26383 - protein, 25 aa, Brucella spp.
YIAPNAILMPSFVNLGAYVDKGAMI

SEQ ID NO: 26384 - protein, 17 aa, Brucella spp.
RATGEVFYGEVPPYSVV

SEQ ID NO: 26385 - protein, 17 aa, Brucella spp.
VFYGEVPPYSVVVAGTM

SEQ ID NO: 26386 - protein, 30 aa, Brucella spp.
YVTPDLCFNFHYFAIRKMHFLMRAKAVCVF

SEQ ID NO: 26387 - protein, 28 aa, Brucella spp.
QTNRMERMPLILFGKEFWTKAINIEFLA

SEQ ID NO: 26388 - protein, 25 aa, Brucella spp.
FAHVTDWVFDLDNTLYPHAANLFAQ

SEQ ID NO: 26389 - protein, 25 aa, Brucella spp.
RKVQKQFYLEYGTTLKGLMECHQID

SEQ ID NO: 26390 - protein, 20 aa, Brucella spp.
HDIDYTWLKPDPALGQAIKA

SEQ ID NO: 26391 - protein, 33 aa, Brucella spp.
AEEGRLLFKKSWIFIRGVPSMKFLPPEGPVEIA

SEQ ID NO: 26392 - protein, 17 aa, Brucella spp.
AWTRLVFDYLRGRTTLK

SEQ ID NO: 26393 - protein, 18 aa, Brucella spp.
LVFDYLRGRTTLKRVYVL

SEQ ID NO: 26394 - protein, 17 aa, Brucella spp.
ITIALSILILALWQVFY

SEQ ID NO: 26395 - protein, 41 aa, Brucella spp.
HIKQFDLLIDWGWFYFITKPMFYLIDWIYKFTGNFGVAILV

SEQ ID NO: 26396 - protein, 17 aa, Brucella spp.
PYTVPHFLMIGVWPIIM

SEQ ID NO: 26397 - protein, 30 aa, Brucella spp.
TVPHFLMIGVWPIIMGIIMFLQMRMNPTPP

SEQ ID NO: 26398 - protein, 29 aa, Brucella spp.
PTQAAIFTWMPIIFTFMLASFPAGLVIYW

SEQ ID NO: 26399 - protein, 18 aa, Brucella spp.
GPLFLMAVRERTEEESNA

SEQ ID NO: 26400 - protein, 24 aa, Brucella spp.
PSTDYVIVAREQALNAPFSQLTEE

SEQ ID NO: 26401 - protein, 24 aa, Brucella spp.
GLPRPRIYWAWATLMVGLTLAVID

SEQ ID NO: 26402 - protein, 29 aa, Brucella spp.
VMLSSLSWPWLFVINIPLGIAAVLMGLRS

SEQ ID NO: 26403 - protein, 35 aa, Brucella spp.
IMSFLAQMMAFISLPFLFQTVFGFRPIEVGFLMMP

SEQ ID NO: 26404 - protein, 27 aa, Brucella spp.
RPIEVGFLMMPWPIALALVAPLSGKLS

SEQ ID NO: 26405 - protein, 24 aa, Brucella spp.
VEGTPYILFLASGFALFASVISIS

SEQ ID NO: 26406 - protein, 27 aa, Brucella spp.
LKESGRYRILQRLDPPPIVPDADRIAF

SEQ ID NO: 26407 - protein, 25 aa, Brucella spp.
IAEADIIIAHNAGFDRPFLERLSIA

SEQ ID NO: 26408 - protein, 27 aa, Brucella spp.
NAGFDRPFLERLSIAFANKPWACSVKE

SEQ ID NO: 26409 - protein, 25 aa, Brucella spp.
LGTLETVIPAFAPVTPVLRRVPLTT

SEQ ID NO: 26410 - protein, 25 aa, Brucella spp.
FAPVTPVLRRVPLTTPQALAVVDPR

SEQ ID NO: 26411 - protein, 24 aa, Brucella spp.
EAGHDLFLPDDVPLPGAKPALRRS

SEQ ID NO: 26412 - protein, 18 aa, Brucella spp.
LRMREALFHGVQAIRLTP

SEQ ID NO: 26413 - protein, 25 aa, Brucella spp.
GDSNGCVVFKDYARFLRAFKRGEVN

SEQ ID NO: 26414 - protein, 23 aa, Brucella spp.
HWAFVLRILCAVALVSVGLAHKI

SEQ ID NO: 26415 - protein, 18 aa, Brucella spp.
TDEDDFFMSLCFCDHCKA

SEQ ID NO: 26416 - protein, 20 aa, Brucella spp.
DDFFMSLCFCDHCKARAKAA

SEQ ID NO: 26417 - protein, 32 aa, Brucella spp.
GISAFAKWPSLYAFLQWRTEPVTSLIGEIRAV

SEQ ID NO: 26418 - protein, 22 aa, Brucella spp.
PASRIVLIDLKDGWLGGVDLEE

SEQ ID NO: 26419 - protein, 21 aa, Brucella spp.
DKYVGLGLSLFYSLVKSKEEF

SEQ ID NO: 26420 - protein, 24 aa, Brucella spp.
GVDGINFYNYGLIPQKRLEWIGAA

SEQ ID NO: 26421 - protein, 28 aa, Brucella spp.
DRSKLLAVNVFLPAIVDFDAMNAVYDAW

SEQ ID NO: 26422 - protein, 24 aa, Brucella spp.
RPGQWKLWLLYTAGFVPAVWTFYL

SEQ ID NO: 26423 - protein, 29 aa, Brucella spp.
EHLLGLWALRFLILTLLVTPMRDLTGITL

SEQ ID NO: 26424 - protein, 18 aa, Brucella spp.
IYLRRREFMIGLGAIAAT

SEQ ID NO: 26425 - protein, 32 aa, Brucella spp.
RMRCVEAWSMVIPWIGFPLSSLLSQVEPLGSA

SEQ ID NO: 26426 - protein, 24 aa, Brucella spp.
GAPIRLVVPWKYGFKGIKAITRIS

SEQ ID NO: 26427 - protein, 24 aa, Brucella spp.
ELRTRLDMLAVATSWTRFGLPEGL

SEQ ID NO: 26428 - protein, 25 aa, Brucella spp.
QFAEEFKYLRAYGPHAFGWKMHDLN

SEQ ID NO: 26429 - protein, 27 aa, Brucella spp.
DTTRDMLEHIFEVNVAGAFFTAQEVAR

SEQ ID NO: 26430 - protein, 24 aa, Brucella spp.
NDLDGVVLLLASDASRYMTGSIIT

SEQ ID NO: 26431 - protein, 24 aa, Brucella spp.
YGNRTTLWFGLLAHVVACVVIYVK

SEQ ID NO: 26432 - protein, 26 aa, Brucella spp.
YVKTADWHFLGFAGIFTFVAFGRLYD

SEQ ID NO: 26433 - protein, 20 aa, Brucella spp.
AVILMSVCTLMPVLAGLILA

SEQ ID NO: 26434 - protein, 34 aa, Brucella spp.
LILAGTPFHIIIGLLLIPYFLSNIQMANGLREFL

SEQ ID NO: 26435 - protein, 20 aa, Brucella spp.
LYLVSGVLFILALRGLSHPT

SEQ ID NO: 26436 - protein, 31 aa, Brucella spp.
LTNTESHFVFWLIVLLSLVFGVLIIVPIGGA

SEQ ID NO: 26437 - protein, 19 aa, Brucella spp.
LFIFDCDGVLVDSEPLSCR

SEQ ID NO: 26438 - protein, 24 aa, Brucella spp.
EAGAAFWPATRTLFAQALQPTVGI

SEQ ID NO: 26439 - protein, 24 aa, Brucella spp.
GKPAPDLFLFAADKMGVDPARCVV

SEQ ID NO: 26440 - protein, 35 aa, Brucella spp.
YKEAMRDFDQAIALNPNFYQAYANRALVDRYMGDN

SEQ ID NO: 26441 - protein, 25 aa, Brucella spp.
RAYHNRGLIYQAKGLHKQAIEDFSK

SEQ ID NO: 26442 - protein, 17 aa, Brucella spp.
LWRSFWETIIMAGFSSL

SEQ ID NO: 26443 - protein, 28 aa, Brucella spp.
NGFRSVPFIILLVALIPVTRFIVGTSIG

SEQ ID NO: 26444 - protein, 18 aa, Brucella spp.
VMIAVVIILIIMVCGIQW

SEQ ID NO: 26445 - protein, 30 aa, Brucella spp.
VRQGDDKWFNIVRWTLFALLEAEELGITQK

SEQ ID NO: 26446 - protein, 26 aa, Brucella spp.
AFQDSTPMLLFIGQVASDQVEREAFQ

SEQ ID NO: 26447 - protein, 26 aa, Brucella spp.
FQEIDYRRMFGQMAKWVVQIDDAARI

SEQ ID NO: 26448 - protein, 25 aa, Brucella spp.
QMGEVMEWLRAHLPADAIITNGAGN

SEQ ID NO: 26449 - protein, 28 aa, Brucella spp.
AGNYSAWPHRFYQYRTYRSQLAPTNGSM

SEQ ID NO: 26450 - protein, 22 aa, Brucella spp.
GANAIFIVVNNGMYGTIRMHQE

SEQ ID NO: 26451 - protein, 18 aa, Brucella spp.
DSMRMFLMGVEGGKPKPG

SEQ ID NO: 26452 - protein, 23 aa, Brucella spp.
TGVQPEWFYKGDGSVLVATGGEL

SEQ ID NO: 26453 - protein, 25 aa, Brucella spp.
VTEKQNYLWLAHSKLRQAALGPELY

SEQ ID NO: 26454 - protein, 19 aa, Brucella spp.
IANLEHHHFKYALFRRPGD

SEQ ID NO: 26455 - protein, 34 aa, Brucella spp.
HHHFKYALFRRPGDIHVHFFGTATLSFSDGVKTE

SEQ ID NO: 26456 - protein, 17 aa, Brucella spp.
CAKPFRYPLVNRLGQAA

SEQ ID NO: 26457 - protein, 28 aa, Brucella spp.
VRHWHPGQQWIWEPGGLGVFDPGINALS

SEQ ID NO: 26458 - protein, 33 aa, Brucella spp.
INALSIVTHILPEAFFLTRSDLYFPANRAAPIA

SEQ ID NO: 26459 - protein, 23 aa, Brucella spp.
DREYQRLYRNFVQLVRERRSDVD

SEQ ID NO: 26460 - protein, 26 aa, Brucella spp.
NVDMTALYLERYMNYGLSQEELQSGR

SEQ ID NO: 26461 - protein, 33 aa, Brucella spp.
AGLDRNLAYLGLVEVLYGYPLDGVVLTIGCDKT

SEQ ID NO: 26462 - protein, 17 aa, Brucella spp.
IVWKARELLAKGEIDYQ

SEQ ID NO: 26463 - protein, 28 aa, Brucella spp.
DWQKYGEEIPLLVNLQPAGEYLGEDYYH

SEQ ID NO: 26464 - protein, 22 aa, Brucella spp.
HAGFRVLRGNLFSSAIMKLSVI

SEQ ID NO: 26465 - protein, 27 aa, Brucella spp.
LEIDEHTVLFMRGAGPIGYPGAAEVVN

SEQ ID NO: 26466 - protein, 26 aa, Brucella spp.
ADWGTTRFRLWTLDADGAVLGESRGD

SEQ ID NO: 26467 - protein, 20 aa, Brucella spp.
VPARRHVIMLPGVARQDETA

SEQ ID NO: 26468 - protein, 26 aa, Brucella spp.
GELADYRTFMTGELFALLKEKSVLAG

SEQ ID NO: 26469 - protein, 24 aa, Brucella spp.
ELVSNRLFSIRAGWLVHDRKPTDQ

SEQ ID NO: 26470 - protein, 17 aa, Brucella spp.
RLSGLLIGLEIAGGRTL

SEQ ID NO: 26471 - protein, 20 aa, Brucella spp.
KLRYPLVAILRGIRPEETEA

SEQ ID NO: 26472 - protein, 23 aa, Brucella spp.
GASALKFFPASVLGAEGIKAVCA

SEQ ID NO: 26473 - protein, 26 aa, Brucella spp.
LLSLVAIMIFFHIVTGGVLMKPLNLT

SEQ ID NO: 26474 - protein, 25 aa, Brucella spp.
VLQNSYIVIMALGMLLIIVTGHIDL

SEQ ID NO: 26475 - protein, 19 aa, Brucella spp.
MMVKLGIPFPIAAILCLIV

SEQ ID NO: 26476 - protein, 24 aa, Brucella spp.
GAIQGFWVAYFNIPSFIVTLAGML

SEQ ID NO: 26477 - protein, 26 aa, Brucella spp.
YLTSLIIGVLLAVFLIWQSMRSRARH

SEQ ID NO: 26478 - protein, 26 aa, Brucella spp.
GLFVVKCILYFVAIAYLSLLISSHRG

SEQ ID NO: 26479 - protein, 23 aa, Brucella spp.
MPNVLIIMAVLIAAYAFLTNRTV

SEQ ID NO: 26480 - protein, 26 aa, Brucella spp.
RDARISIFDRGFLFGDGIYEVTAVLE

SEQ ID NO: 26481 - protein, 25 aa, Brucella spp.
KRRDIKTVCLLPQALTKEIAKNAGC

SEQ ID NO: 26482 - protein, 25 aa, Brucella spp.
PGCTRLSLLQLITETGMKLEERLFT

SEQ ID NO: 26483 - protein, 17 aa, Brucella spp.
DGPFSVFPGIDRTLSVL

SEQ ID NO: 26484 - protein, 19 aa, Brucella spp.
FSVFPGIDRTLSVLAGDGI

SEQ ID NO: 26485 - protein, 23 aa, Brucella spp.
GKGTTYLISIRAFPAENKSKSHC

SEQ ID NO: 26486 - protein, 25 aa, Brucella spp.
ILADTDWHIHKLYDGLIDGATFVRA

SEQ ID NO: 26487 - protein, 34 aa, Brucella spp.
VAILYDCHSIRSHIPFLFEGKLPDFNIGTDMGKT

SEQ ID NO: 26488 - protein, 33 aa, Brucella spp.
AISQRRIALLVDPSLSFGLPAFLARKPGLNSGL

SEQ ID NO: 26489 - protein, 26 aa, Brucella spp.
ACHGARRLLQMTANLNAIIGIEALTG

SEQ ID NO: 26490 - protein, 19 aa, Brucella spp.
FIHARQALLPDGWAENVRI

SEQ ID NO: 26491 - protein, 31 aa, Brucella spp.
GPSADSFWSWREIMYKFALTMTPEQAEAVAL

SEQ ID NO: 26492 - protein, 24 aa, Brucella spp.
AVALRLYVDMLEAGFTRVGEFHYL

SEQ ID NO: 26493 - protein, 25 aa, Brucella spp.
AGMGLTLLPVFYAHSGFGGAAANEG

SEQ ID NO: 26494 - protein, 18 aa, Brucella spp.
PVEWLLDHQDVTARWCLI

SEQ ID NO: 26495 - protein, 27 aa, Brucella spp.
EVAALGLPYRFELMNRWERLSGPADAR

SEQ ID NO: 26496 - protein, 23 aa, Brucella spp.
PLVELLCRHYAGKRVFALEERII

SEQ ID NO: 26497 - protein, 24 aa, Brucella spp.
AVALKPFLKPDATLYVLNGLQPGT

SEQ ID NO: 26498 - protein, 27 aa, Brucella spp.
TFLGKTYYFDLARPGIALYGIDPERQH

SEQ ID NO: 26499 - protein, 26 aa, Brucella spp.
NKKPKHSILPVLTLSARVIQVRDVDK

SEQ ID NO: 26500 - protein, 22 aa, Brucella spp.
DCDTIPYEILTALGNRYARVYV

SEQ ID NO: 26501 - protein, 23 aa, Brucella spp.
RRVPKMFFDYADSGAWTESTYRA

SEQ ID NO: 26502 - protein, 28 aa, Brucella spp.
ASVTKKPFWFQLYVMRDRDFVKNLIGRA

SEQ ID NO: 26503 - protein, 25 aa, Brucella spp.
KFTPKHIWQMATCPAWCLGMLGTQR

SEQ ID NO: 26504 - protein, 23 aa, Brucella spp.
AQGVYIGRPFLYGLGAMGNEGVT

SEQ ID NO: 26505 - protein, 30 aa, Brucella spp.
RASNEAAFLYQLFVRAYGTNNFPDCSNMCH

SEQ ID NO: 26506 - protein, 18 aa, Brucella spp.
QAGRVICTWAMGITQHRH

SEQ ID NO: 26507 - protein, 17 aa, Brucella spp.
CTWAMGITQHRHSVITI

SEQ ID NO: 26508 - protein, 33 aa, Brucella spp.
QHRHSVITIREITNFMLLRGNIGKPGAGLCPVR

SEQ ID NO: 26509 - protein, 18 aa, Brucella spp.
LNHSHLVPGRDSFILPCL

SEQ ID NO: 26510 - protein, 21 aa, Brucella spp.
HLVPGRDSFILPCLGRTEIDL

SEQ ID NO: 26511 - protein, 25 aa, Brucella spp.
TLGPKPVDWLALADDYDLIREHIAR

SEQ ID NO: 26512 - protein, 17 aa, Brucella spp.
TFWTGALPQAIEHQQVR

SEQ ID NO: 26513 - protein, 25 aa, Brucella spp.
VYGERHVVFMNPLDMADLGVEAGDR

SEQ ID NO: 26514 - protein, 25 aa, Brucella spp.
ERVAANFRFVPYDIPRGCIAGYYPE

SEQ ID NO: 26515 - protein, 19 aa, Brucella spp.
TCIQILSAGSPAYADSLNV

SEQ ID NO: 26516 - protein, 17 aa, Brucella spp.
FKRQQALLKQGFTTRSQ

SEQ ID NO: 26517 - protein, 31 aa, Brucella spp.
VTGTVHMDARQVIVLPWSAMASEAGRTAVWR

SEQ ID NO: 26518 - protein, 28 aa, Brucella spp.
VDRDTHVATLVPIKVLAYEKERVIVESG

SEQ ID NO: 26519 - protein, 26 aa, Brucella spp.
VVSLSIPLVLAITFLSMSLMDISLQR

SEQ ID NO: 26520 - protein, 27 aa, Brucella spp.
QAGEYTFTLFVVIAVSLLVSWVVAVLF

SEQ ID NO: 26521 - protein, 18 aa, Brucella spp.
VLFAPLLGVTFLPKKMKP

SEQ ID NO: 26522 - protein, 19 aa, Brucella spp.
VLLLSMRHKWTTIITTIVL

SEQ ID NO: 26523 - protein, 32 aa, Brucella spp.
SMRHKWTTIITTIVLFVISVFGMGFIERQFFP

SEQ ID NO: 26524 - protein, 30 aa, Brucella spp.
PIAAVVPLMLFVMATVLMVQLQSFQRLFLV

SEQ ID NO: 26525 - protein, 30 aa, Brucella spp.
VLMVQLQSFQRLFLVVAVAPLGLIGVVAAL

SEQ ID NO: 26526 - protein, 28 aa, Brucella spp.
IAGTAITLLFLPALYVAWFRIKEPEHSP

SEQ ID NO: 26527 - protein, 27 aa, Brucella spp.
SDHAATFFKYLIEIATGVPVASIGPSI

SEQ ID NO: 26528 - protein, 27 aa, Brucella spp.
LMHGPMRLIEEGFPIVSFLPRDEAFDT

SEQ ID NO: 26529 - protein, 29 aa, Brucella spp.
STGSPHLDPLVSLINYYRVIEAVTRRKGF

SEQ ID NO: 26530 - protein, 24 aa, Brucella spp.
KYGTTSLLPTLITDTMPVRDRAIE

SEQ ID NO: 26531 - protein, 26 aa, Brucella spp.
DADIALYIHTARQIGTLLVTLAAEQV

SEQ ID NO: 26532 - protein, 26 aa, Brucella spp.
AKRGDAHLFLVTDAMALVGSDAESFE

SEQ ID NO: 26533 - protein, 30 aa, Brucella spp.
TLAEALRMASLYPARYLRLNDRGRFRPGMR

SEQ ID NO: 26534 - protein, 17 aa, Brucella spp.
FNDVIARLSGLRDRLAA

SEQ ID NO: 26535 - protein, 26 aa, Brucella spp.
YRAGGLAITVPILCGSIMLQDGAVAS

SEQ ID NO: 26536 - protein, 21 aa, Brucella spp.
VRPILDRYGIRDGDVLVVVSN

SEQ ID NO: 26537 - protein, 22 aa, Brucella spp.
DTGRFFMRVSFISEEGVLLDEL

SEQ ID NO: 26538 - protein, 28 aa, Brucella spp.
FGHCLNDLLYRWKIGALPIDIVGVVSNH

SEQ ID NO: 26539 - protein, 24 aa, Brucella spp.
KMSGRIINIHHSFLPSFKGANPYK

SEQ ID NO: 26540 - protein, 25 aa, Brucella spp.
GLVNAGMWVMPDDLPGVLGQKYGDR

SEQ ID NO: 26541 - protein, 18 aa, Brucella spp.
YGDRLLDVLGNAPKLVFE

SEQ ID NO: 26542 - protein, 19 aa, Brucella spp.
LDVLGNAPKLVFEIIEKHK

SEQ ID NO: 26543 - protein, 28 aa, Brucella spp.
AEVRAELVHLPYFNMATKPLSDNLKKSI

SEQ ID NO: 26544 - protein, 24 aa, Brucella spp.
KEVLSSFRFDQQGRLVFGSVGALR

SEQ ID NO: 26545 - protein, 24 aa, Brucella spp.
AKKSLKRLFPQIGAVEFEAEWYGK

SEQ ID NO: 26546 - protein, 17 aa, Brucella spp.
SLPKFHRLARNVVGFSG

SEQ ID NO: 26547 - protein, 37 aa, Brucella spp.
GATLPGDRWLMEVAGWAWRVKLSLTLSLDLMRDLRER

SEQ ID NO: 26548 - protein, 18 aa, Brucella spp.
VFARDLKDLLLAAPAGSR

SEQ ID NO: 26549 - protein, 25 aa, Brucella spp.
KSLDPRVFVDERFGLPTVRDIIAEL

SEQ ID NO: 26550 - protein, 24 aa, Brucella spp.
PNDLNVIYYEQRASAGLIITEATP

SEQ ID NO: 26551 - protein, 24 aa, Brucella spp.
IENRARFLFEVVDAVTKAIGAGKV

SEQ ID NO: 26552 - protein, 26 aa, Brucella spp.
DPDPQPLFDYVIGKLAACGLAYIHII

SEQ ID NO: 26553 - protein, 17 aa, Brucella spp.
FGKPFIANPDLVRRLKE

SEQ ID NO: 26554 - protein, 27 aa, Brucella spp.
AEKGRKQFVLWLDAHTDFHTLETTTSG

SEQ ID NO: 26555 - protein, 23 aa, Brucella spp.
REAHLIMEMLHDSGLVTSLDLVE

SEQ ID NO: 26556 - protein, 27 aa, Brucella spp.
VPFVSVDHMMKLVLRVGVETFLKELAG

SEQ ID NO: 26557 - protein, 27 aa, Brucella spp.
DVGSGYPMLLTEMTILTALRTAATSAV

SEQ ID NO: 26558 - protein, 19 aa, Brucella spp.
ILRRSDIFVEYPPQTRIEG

SEQ ID NO: 26559 - protein, 24 aa, Brucella spp.
EPRDLYGMLLRHEKLLQSESTKPA

SEQ ID NO: 26560 - protein, 17 aa, Brucella spp.
LFLKDKKDNFFLVTVEE

SEQ ID NO: 26561 - protein, 25 aa, Brucella spp.
GKPEKLMEYLGVIPGSVTVFGAAND

SEQ ID NO: 26562 - protein, 18 aa, Brucella spp.
VILDAGLMKYDIINGHPL

SEQ ID NO: 26563 - protein, 31 aa, Brucella spp.
DIPDVVPVFPLKGALLLPGGQLPLNIFEPRY

SEQ ID NO: 26564 - protein, 24 aa, Brucella spp.
GGQLPLNIFEPRYLSMVENALAGK

SEQ ID NO: 26565 - protein, 17 aa, Brucella spp.
LITLQGICRFRVQEELH

SEQ ID NO: 26566 - protein, 25 aa, Brucella spp.
CRQPYRQCRIMPFLADLEQAQDAGD

SEQ ID NO: 26567 - protein, 27 aa, Brucella spp.
EVIEGLDILILRELTGGVYFGEPKEII

SEQ ID NO: 26568 - protein, 33 aa, Brucella spp.
DAGGMQLVRWPKQFDVILTDNLFGDLLSDVAAM

SEQ ID NO: 26569 - protein, 19 aa, Brucella spp.
IASLAMCLRYSFGLVAEAD

SEQ ID NO: 26570 - protein, 19 aa, Brucella spp.
AMCLRYSFGLVAEADRLEA

SEQ ID NO: 26571 - protein, 25 aa, Brucella spp.
LGTVFEWYDFYLYGTLASFIGAAFF

SEQ ID NO: 26572 - protein, 24 aa, Brucella spp.
SASLGIFAPIILIALRMLQGLALG

SEQ ID NO: 26573 - protein, 28 aa, Brucella spp.
AFAAWGWRIPFLVSVLLLGISVWIRMQM

SEQ ID NO: 26574 - protein, 27 aa, Brucella spp.
AGQAVVWYCGQFYALFFLQNVLKVENQ

SEQ ID NO: 26575 - protein, 24 aa, Brucella spp.
IGTGFFVIFGWLSDKIGRKPIIMA

SEQ ID NO: 26576 - protein, 26 aa, Brucella spp.
PAQVNWVLTIAILTILVIYVTMVYGP

SEQ ID NO: 26577 - protein, 27 aa, Brucella spp.
KGDIYYGLWYPIIIASVTFVIGMLFVK

SEQ ID NO: 26578 - protein, 25 aa, Brucella spp.
IDNSSAWRYDADVPLIVPEVNPDAI

SEQ ID NO: 26579 - protein, 29 aa, Brucella spp.
TKKFTKRIAFNVIPHIDVFMEDGYTKEEW

SEQ ID NO: 26580 - protein, 24 aa, Brucella spp.
ITVENGLAMWVVSDNLRKGAALNA

SEQ ID NO: 26581 - protein, 29 aa, Brucella spp.
PEQLFASGYAACFLGALKFAAAKEKISIP

SEQ ID NO: 26582 - protein, 21 aa, Brucella spp.
GTGFGLDVALSIALPGIDKAK

SEQ ID NO: 26583 - protein, 24 aa, Brucella spp.
NIDTDMIIPKDYLKTIKRTGLGKG

SEQ ID NO: 26584 - protein, 35 aa, Brucella spp.
LLDYGIRCVISTSFADIFYNNCFKNGILPIKVAQE

SEQ ID NO: 26585 - protein, 26 aa, Brucella spp.
ATDEQLDFPILYGSGRNGWMALSPEG

SEQ ID NO: 26586 - protein, 27 aa, Brucella spp.
DQGLAPLFDLVLKHVPAPKVAEGPFRM

SEQ ID NO: 26587 - protein, 26 aa, Brucella spp.
VAEGPFRMIGTILEADPFLGRIITGR

SEQ ID NO: 26588 - protein, 27 aa, Brucella spp.
SGGNRVRLVFYAPTRGLIGYQSELLTD

SEQ ID NO: 26589 - protein, 26 aa, Brucella spp.
TRGTAIMNRLFHDYQPYKGEIAGRNN

SEQ ID NO: 26590 - protein, 19 aa, Brucella spp.
IVMFTISRVETFSQEIKKS

SEQ ID NO: 26591 - protein, 17 aa, Brucella spp.
SATHNCWAWRMGQNYRF

SEQ ID NO: 26592 - protein, 18 aa, Brucella spp.
NCWAWRMGQNYRFSDDGE

SEQ ID NO: 26593 - protein, 29 aa, Brucella spp.
QLDNIVVVVTRWFGGILLGSGGLMRAYGG

SEQ ID NO: 26594 - protein, 26 aa, Brucella spp.
DVGSHNLFVELLIAAGVASILSEEAD

SEQ ID NO: 26595 - protein, 21 aa, Brucella spp.
PLGTIFSIFPADVEEPFLQPG

SEQ ID NO: 26596 - protein, 24 aa, Brucella spp.
PRGRNFNMRWLGAAVGDMHRIMQR

SEQ ID NO: 26597 - protein, 33 aa, Brucella spp.
AAVGDMHRIMQRGGLFFYVNDSRPGYEKGRLRL

SEQ ID NO: 26598 - protein, 25 aa, Brucella spp.
YEKGRLRLVYEANPIAFLAREAGGK

SEQ ID NO: 26599 - protein, 37 aa, Brucella spp.
RSYANDIMLRHMMDAVTEIYPHIPVCVHLDHGNEAAT

SEQ ID NO: 26600 - protein, 26 aa, Brucella spp.
LDGTYDRAILVCGTGIGVCIAANKVP

SEQ ID NO: 26601 - protein, 22 aa, Brucella spp.
ALRAAWLHFVAGMTQSAVAKRL

SEQ ID NO: 26602 - protein, 34 aa, Brucella spp.
SAAVVYMPRVMANDLRFVSLLGGLTRNFAANPHD

SEQ ID NO: 26603 - protein, 29 aa, Brucella spp.
IAEKTGMPAYMMPVPFFANTAEDREVLLA

SEQ ID NO: 26604 - protein, 20 aa, Brucella spp.
GEMLGHFFNANGQWLETALT

SEQ ID NO: 26605 - protein, 29 aa, Brucella spp.
LLNAAPHIIWPMRFVLPHSPQDRPAWLVR

SEQ ID NO: 26606 - protein, 28 aa, Brucella spp.
SPQDRPAWLVRLGLFLYDHLGGRKKLPG

SEQ ID NO: 26607 - protein, 24 aa, Brucella spp.
PVGDAWIWLDARAASTVTRLAAGP

SEQ ID NO: 26608 - protein, 26 aa, Brucella spp.
AALHCKDWLYLNLTGVRATDPSEASF

SEQ ID NO: 26609 - protein, 24 aa, Brucella spp.
EGTGYVIALPIPGIVTQVQTNMGA

SEQ ID NO: 26610 - protein, 27 aa, Brucella spp.
NMGATINIDWILQVAADLMSTPEKPVS

SEQ ID NO: 26611 - protein, 20 aa, Brucella spp.
IPRLDDWFNASRPGAILYHP

SEQ ID NO: 26612 - protein, 17 aa, Brucella spp.
WFNASRPGAILYHPYIS

SEQ ID NO: 26613 - protein, 25 aa, Brucella spp.
HQYEELFVAYREARLALAPVWDKLA

SEQ ID NO: 26614 - protein, 27 aa, Brucella spp.
TRPSRAALWSVIAAVVVIGAIGFDTKV

SEQ ID NO: 26615 - protein, 24 aa, Brucella spp.
AGKSTLMKVLSGVIQPTLGTIILD

SEQ ID NO: 26616 - protein, 18 aa, Brucella spp.
VIQPTLGTIILDGKPVTF

SEQ ID NO: 26617 - protein, 23 aa, Brucella spp.
DHGISIIHQELSLAPNMNVRDNI

SEQ ID NO: 26618 - protein, 23 aa, Brucella spp.
SVNSRILIMDEPTSALSASEVEV

SEQ ID NO: 26619 - protein, 26 aa, Brucella spp.
SASEVEVLFKVIRDLTARGVAIVYIS

SEQ ID NO: 26620 - protein, 26 aa, Brucella spp.
REEIDLEWIVRNMVGENFDLGSPPTG

SEQ ID NO: 26621 - protein, 27 aa, Brucella spp.
ECLSIAHRIIVMHRGRISAEFGSDVSK

SEQ ID NO: 26622 - protein, 35 aa, Brucella spp.
EGRAFFALIAIIAVFSFLSPYYFTVDNFLIMSSHV

SEQ ID NO: 26623 - protein, 29 aa, Brucella spp.
VTLQEFGIILYFPVWAVVLITCALGAFVG

SEQ ID NO: 26624 - protein, 28 aa, Brucella spp.
KRAIAANIPVFLINAEINQEGLAKAQLV

SEQ ID NO: 26625 - protein, 25 aa, Brucella spp.
KAGELQYTVLQPVAVFSEAAVKQAD

SEQ ID NO: 26626 - protein, 27 aa, Brucella spp.
VDHEKQLFDCILITKDNVDKYNSPFVL

SEQ ID NO: 26627 - protein, 33 aa, Brucella spp.
MPIHSRIWLDRPEIIRWFQIIGYHENGNENGAK

SEQ ID NO: 26628 - protein, 25 aa, Brucella spp.
AQEHELPFWLQATPDDIAGLEFEAP

SEQ ID NO: 26629 - protein, 29 aa, Brucella spp.
RSSNPVPVHWFFEMDLDFGISDPSIIAAE

SEQ ID NO: 26630 - protein, 28 aa, Brucella spp.
LEGERDLIDLLLIFADLEQSPSPKKLME

SEQ ID NO: 26631 - protein, 24 aa, Brucella spp.
CVSALYILTPMLENSLRHILKLNG

SEQ ID NO: 26632 - protein, 30 aa, Brucella spp.
GTDAIYACWLIFRLCCIPLFEQRERLRLPS

SEQ ID NO: 26633 - protein, 25 aa, Brucella spp.
VNRRKSILFSDLSAFKFGLPPLTEQ

SEQ ID NO: 26634 - protein, 26 aa, Brucella spp.
KALLKQYFVERQQSLLWSCVAKMGRW

SEQ ID NO: 26635 - protein, 19 aa, Brucella spp.
SLLWSCVAKMGRWLSGGTP

SEQ ID NO: 26636 - protein, 27 aa, Brucella spp.
MVGPGTLLLVVRGMILARSVPSTICTV

SEQ ID NO: 26637 - protein, 28 aa, Brucella spp.
EGVAPAFLKLWLDINEHKLLGEIETATH

SEQ ID NO: 26638 - protein, 31 aa, Brucella spp.
SIDSSDYKIYIFGFLFLKRLSDRFEEEAKES

SEQ ID NO: 26639 - protein, 20 aa, Brucella spp.
EFYTPHHVVRLIVELLAPKP

SEQ ID NO: 26640 - protein, 19 aa, Brucella spp.
HVVRLIVELLAPKPGMRIS

SEQ ID NO: 26641 - protein, 26 aa, Brucella spp.
LDQDGNLFLYDRVIANPPFSLDSWGA

SEQ ID NO: 26642 - protein, 19 aa, Brucella spp.
LVTGRGTLLKFGLVGDETA

SEQ ID NO: 26643 - protein, 25 aa, Brucella spp.
ATGGALFAILSSDVFRPKIEVLRRG

SEQ ID NO: 26644 - protein, 20 aa, Brucella spp.
FRPKIEVLRRGATTLLSLSP

SEQ ID NO: 26645 - protein, 17 aa, Brucella spp.
EVLRRGATTLLSLSPKD

SEQ ID NO: 26646 - protein, 19 aa, Brucella spp.
RLLTDIHRTLSRLNNDQID

SEQ ID NO: 26647 - protein, 31 aa, Brucella spp.
DRLRIPVVGAPLFIISHPALVLAQCKAGVVG

SEQ ID NO: 26648 - protein, 28 aa, Brucella spp.
SPFALIQEIRSWFDGPLLLSGAIANGRS

SEQ ID NO: 26649 - protein, 21 aa, Brucella spp.
KETIWLSTFGLLSNQKAVSFV

SEQ ID NO: 26650 - protein, 36 aa, Brucella spp.
KKKRHSPFYSYGIPALVLLVAVMIGYSLYNSLSDLG

SEQ ID NO: 26651 - protein, 26 aa, Brucella spp.
PGGAKWINIFLPDEATRISVQGSATA

SEQ ID NO: 26652 - protein, 24 aa, Brucella spp.
NESLNDFLFDMDFSASRKPGGAGT

SEQ ID NO: 26653 - protein, 31 aa, Brucella spp.
AASATFLLPDRFVKWFAAKGWSPRAHQLELL

SEQ ID NO: 26654 - protein, 22 aa, Brucella spp.
GVHTLYISPLKALAVDIRRNLT

SEQ ID NO: 26655 - protein, 23 aa, Brucella spp.
LAPPDILLTTPEQLALLIASRVA

SEQ ID NO: 26656 - protein, 22 aa, Brucella spp.
VAEQFFKDLRYVVLDELHSLVI

SEQ ID NO: 26657 - protein, 17 aa, Brucella spp.
ISKRGHLLALGLARLRR

SEQ ID NO: 26658 - protein, 24 aa, Brucella spp.
SQAEMLFQELWRVNEETLPIALHH

SEQ ID NO: 26659 - protein, 24 aa, Brucella spp.
GRIEEYFLETLTAGDTFLFAGKVL

SEQ ID NO: 26660 - protein, 17 aa, Brucella spp.
AGDTFLFAGKVLRFEGI

SEQ ID NO: 26661 - protein, 18 aa, Brucella spp.
FLFAGKVLRFEGIRENEC

SEQ ID NO: 26662 - protein, 25 aa, Brucella spp.
LADRARWQFLPQQVREWLEVQQWKS

SEQ ID NO: 26663 - protein, 27 aa, Brucella spp.
ETFPRGNRFYMVAYPFEGRLAHQTLGM

SEQ ID NO: 26664 - protein, 18 aa, Brucella spp.
LHKPLDQISPLALPVMLE

SEQ ID NO: 26665 - protein, 17 aa, Brucella spp.
DQISPLALPVMLEIGRE

SEQ ID NO: 26666 - protein, 29 aa, Brucella spp.
VGGGFLITPLLIFYNIPPAIAVATGANQV

SEQ ID NO: 26667 - protein, 25 aa, Brucella spp.
LIVSILYVFFLGTIGGLMLVESVQA

SEQ ID NO: 26668 - protein, 18 aa, Brucella spp.
WIHRLPFKMRFRASTIYV

SEQ ID NO: 26669 - protein, 25 aa, Brucella spp.
GVGGGFIMVPALIYLLHVPTNVVVG

SEQ ID NO: 26670 - protein, 21 aa, Brucella spp.
EQLRLLLALLVLAVGMRLAFG

SEQ ID NO: 26671 - protein, 24 aa, Brucella spp.
REDSDALFRRLGELSQRIDALQAN

SEQ ID NO: 26672 - protein, 25 aa, Brucella spp.
TSRPHEPFFKSDFASLKPARRENPV

SEQ ID NO: 26673 - protein, 39 aa, Brucella spp.
KKASIADILHRQRKPILFAIGAVMIAIAGLQVGTAFLNR

SEQ ID NO: 26674 - protein, 21 aa, Brucella spp.
ASAMHNLAVLFATGTNGTPDN

SEQ ID NO: 26675 - protein, 22 aa, Brucella spp.
DSQYNLGILAAKGLGMPVNLEE

SEQ ID NO: 26676 - protein, 23 aa, Brucella spp.
GMPVNLEESYKWFALAANAGDKD

SEQ ID NO: 26677 - protein, 26 aa, Brucella spp.
MKKAVRNIQLILQKNGYDTGTADGMM

SEQ ID NO: 26678 - protein, 22 aa, Brucella spp.
HTAKILRLSQDLPTVIEIVDAP

SEQ ID NO: 26679 - protein, 25 aa, Brucella spp.
APEKIEHFIPQVMKMTQSCLITTEK

SEQ ID NO: 26680 - protein, 23 aa, Brucella spp.
RSHPDIIYDLAHPATPRSALGFI

SEQ ID NO: 26681 - protein, 24 aa, Brucella spp.
TLKVLDQWPITTEPFSQWVIEDRF

SEQ ID NO: 26682 - protein, 25 aa, Brucella spp.
DVAAFELMKLRLLNGSHSTLAYLGF

SEQ ID NO: 26683 - protein, 24 aa, Brucella spp.
KQLIKALMEIEIAPTLPKLEGFDL

SEQ ID NO: 26684 - protein, 17 aa, Brucella spp.
IHRFENHALHHLTSQIA

SEQ ID NO: 26685 - protein, 18 aa, Brucella spp.
GGGSIDLLALGVAAWMRY

SEQ ID NO: 26686 - protein, 20 aa, Brucella spp.
SIDLLALGVAAWMRYVTGKD

SEQ ID NO: 26687 - protein, 32 aa, Brucella spp.
FAPDEIMDALLSFRQIFTARLAANELFREKLR

SEQ ID NO: 26688 - protein, 22 aa, Brucella spp.
ANELFREKLRLALGSLYAVGSA

SEQ ID NO: 26689 - protein, 22 aa, Brucella spp.
GYAKHPNFGGVLLIGLGCETNQ

SEQ ID NO: 26690 - protein, 20 aa, Brucella spp.
APILEHYRIEEGSRLRAMTI

SEQ ID NO: 26691 - protein, 27 aa, Brucella spp.
AVAEKLLQRIDWWRDYTARNGDELNNN

SEQ ID NO: 26692 - protein, 25 aa, Brucella spp.
TITEQGFVFMDAPGYDPVAVTGQVA

SEQ ID NO: 26693 - protein, 24 aa, Brucella spp.
EAGARIFDHILAVASGQKTLSEIY

SEQ ID NO: 26694 - protein, 19 aa, Brucella spp.
LILAFAFVSVAFVSGAHAD

SEQ ID NO: 26695 - protein, 22 aa, Brucella spp.
DPKLNFSWPVNVGPLNPHLYSP

SEQ ID NO: 26696 - protein, 36 aa, Brucella spp.
INLKKPYYPLLQELSLPRPFRFIAPSQFKNGGTADG

SEQ ID NO: 26697 - protein, 26 aa, Brucella spp.
QRDGRFDMIFNQTWGAPYDPHAFVSS

SEQ ID NO: 26698 - protein, 17 aa, Brucella spp.
YKDILTRLHEEAVYLPL

SEQ ID NO: 26699 - protein, 31 aa, Brucella spp.
LGVSMPNFWLGFLLVLVFSIQLGWLPPMGRG

SEQ ID NO: 26700 - protein, 18 aa, Brucella spp.
VRLACIIVLLLLVAAVAG

SEQ ID NO: 26701 - protein, 25 aa, Brucella spp.
RITDVFLTFPTLVLALFMVGMLGTG

SEQ ID NO: 26702 - protein, 32 aa, Brucella spp.
INDARQFVWTAPMLILWPGLALFLSVMAFNIL

SEQ ID NO: 26703 - protein, 22 aa, Brucella spp.
EERIQELLRLVELPPEIADRLP

SEQ ID NO: 26704 - protein, 17 aa, Brucella spp.
RICIARALAVNPKLIIL

SEQ ID NO: 26705 - protein, 23 aa, Brucella spp.
AVNPKLIILDEAVSNLDIHLQAS

SEQ ID NO: 26706 - protein, 17 aa, Brucella spp.
VSNLDIHLQASALALLT

SEQ ID NO: 26707 - protein, 17 aa, Brucella spp.
NLDIHLQASALALLTKL

SEQ ID NO: 26708 - protein, 18 aa, Brucella spp.
DIHLQASALALLTKLQQE

SEQ ID NO: 26709 - protein, 27 aa, Brucella spp.
QQEGGIAYLFVTHDLRLVQKFAARCLV

SEQ ID NO: 26710 - protein, 22 aa, Brucella spp.
PASRLLREAVLPPLPVRAVETN

SEQ ID NO: 26711 - protein, 36 aa, Brucella spp.
GMSGGAWYMDPSVGFPGYFMPQGVSADLIATKYGFS

SEQ ID NO: 26712 - protein, 38 aa, Brucella spp.
KISDIDLFELNEAFAAVVLRYMQAFDIPHDKINVNGGA

SEQ ID NO: 26713 - protein, 26 aa, Brucella spp.
QTTEAGMMIRSLFVSLQELNKGARRP

SEQ ID NO: 26714 - protein, 33 aa, Brucella spp.
SKRPKNFIGIHFFSPVDKMMLVEVILGKKTSDK

SEQ ID NO: 26715 - protein, 25 aa, Brucella spp.
GFYVNRCVLRYMSEAYNMLVEGVPA

SEQ ID NO: 26716 - protein, 24 aa, Brucella spp.
KPAKKHLWPGLKDLYPQQNPDKID

SEQ ID NO: 26717 - protein, 17 aa, Brucella spp.
ELKERFLVTIALEAARV

SEQ ID NO: 26718 - protein, 17 aa, Brucella spp.
KERFLVTIALEAARVME

SEQ ID NO: 26719 - protein, 20 aa, Brucella spp.
HAHFVFGSLACLTGAVLIAA

SEQ ID NO: 26720 - protein, 31 aa, Brucella spp.
LACLTGAVLIAAFVAPFYGALDRRVVVIDSG

SEQ ID NO: 26721 - protein, 23 aa, Brucella spp.
GEQMQLLQRPVAVAAGRLESQGR

SEQ ID NO: 26722 - protein, 26 aa, Brucella spp.
GMQARTAFRQWLRSRAVMCRLPENDS

SEQ ID NO: 26723 - protein, 24 aa, Brucella spp.
AALEPYLQMPLSSVPNPFGGDYKS

SEQ ID NO: 26724 - protein, 25 aa, Brucella spp.
EHNNAMLCRFLDTFGFDYEFASATE

SEQ ID NO: 26725 - protein, 20 aa, Brucella spp.
LQWKPDFGMRWAALGVDFEM

SEQ ID NO: 26726 - protein, 25 aa, Brucella spp.
GRAPEHFVYELFLDQLGQKISKSKG

SEQ ID NO: 26727 - protein, 25 aa, Brucella spp.
DRLNNPVWHIHYGNPPKADLPVTFA

SEQ ID NO: 26728 - protein, 23 aa, Brucella spp.
VGYAIRYFNDFVKPTKKFRAPDD

SEQ ID NO: 26729 - protein, 26 aa, Brucella spp.
PGVSVSFFQMLYEVLIGQERGPRFGS

SEQ ID NO: 26730 - protein, 17 aa, Brucella spp.
HDGHAPIYLHHAFHEAV

SEQ ID NO: 26731 - protein, 26 aa, Brucella spp.
KITRISVVFRRLWNCTDTVPRDTLEA

SEQ ID NO: 26732 - protein, 24 aa, Brucella spp.
GNMGFAMLRGWLDSGILKAGDVHV

SEQ ID NO: 26733 - protein, 24 aa, Brucella spp.
PADLQPRMVLVAVKPQMMANVLPA

SEQ ID NO: 26734 - protein, 17 aa, Brucella spp.
AVKPQMMANVLPAYKRF

SEQ ID NO: 26735 - protein, 19 aa, Brucella spp.
QMMANVLPAYKRFAPASTF

SEQ ID NO: 26736 - protein, 27 aa, Brucella spp.
SGSGPAYIFHFIEALTDAGVNLGLPRE

SEQ ID NO: 26737 - protein, 26 aa, Brucella spp.
NNDPAIHGILVQLPLPGHIDSGRVIQ

SEQ ID NO: 26738 - protein, 19 aa, Brucella spp.
EKDVDGFHFINVGKLGTGE

SEQ ID NO: 26739 - protein, 27 aa, Brucella spp.
SNIVGKPMFNLLLAANATVTVAHSRTK

SEQ ID NO: 26740 - protein, 24 aa, Brucella spp.
VGPMTIAMLMANTLTAACRSAGMK

SEQ ID NO: 26741 - protein, 17 aa, Brucella spp.
VCDKIVPGLIVGALTFG

SEQ ID NO: 26742 - protein, 37 aa, Brucella spp.
DKIVPGLIVGALTFGHLPPVFIPAGPMTSGLPNDEKA

SEQ ID NO: 26743 - protein, 29 aa, Brucella spp.
TANSNQMLMEIMGLHLPGASFINPGTPLR

SEQ ID NO: 26744 - protein, 27 aa, Brucella spp.
HAAGGMGFLIRELLDGGLLHEDVRTVW

SEQ ID NO: 26745 - protein, 25 aa, Brucella spp.
ANGMPELHKLMTVLGILQDRGQRVA

SEQ ID NO: 26746 - protein, 28 aa, Brucella spp.
LFEVLSRKMIDWNLVTITLVDERFVPVE

SEQ ID NO: 26747 - protein, 22 aa, Brucella spp.
EKRLTLTLPLIAEAEMLVLHIE

SEQ ID NO: 26748 - protein, 23 aa, Brucella spp.
QAEVEIFLKRLHYVAVDAKSDEG

SEQ ID NO: 26749 - protein, 26 aa, Brucella spp.
KKPEKIRAFYLAVSPTLFGDIATRLK

SEQ ID NO: 26750 - protein, 25 aa, Brucella spp.
ETVQNLMALRFANALYEPLWNSAHI

SEQ ID NO: 26751 - protein, 24 aa, Brucella spp.
DMVQNHILQLLCLVAMEPPSSIEA

SEQ ID NO: 26752 - protein, 25 aa, Brucella spp.
LKAEIANWRWAGVPFYLRTGKRLAT

SEQ ID NO: 26753 - protein, 23 aa, Brucella spp.
RVSEIVITFKPIPHSIFGESAGK

SEQ ID NO: 26754 - protein, 27 aa, Brucella spp.
DEVEAAWRWIDPILQAWEFNSQPVQGY

SEQ ID NO: 26755 - protein, 24 aa, Brucella spp.
FAATRFSMLPTVLIGMGAASICRY

SEQ ID NO: 26756 - protein, 24 aa, Brucella spp.
IVSGFPVLLGMIPFALVLGAQAAH

SEQ ID NO: 26757 - protein, 30 aa, Brucella spp.
AALNLAYYMGVAIPFYLAWVMSATLGAVFG

SEQ ID NO: 26758 - protein, 24 aa, Brucella spp.
RREKLKLFEELRIPPFPGGRTFRS

SEQ ID NO: 26759 - protein, 22 aa, Brucella spp.
AEPLGIRFLGVGGSPKWTLAET

SEQ ID NO: 26760 - protein, 23 aa, Brucella spp.
RSGVLPFVFSENFGFADYVNWAL

SEQ ID NO: 26761 - protein, 34 aa, Brucella spp.
FGFADYVNWALDVPMYFILRDGHYHDCTHVSFRQ

SEQ ID NO: 26762 - protein, 30 aa, Brucella spp.
GADGGPWRRICALPAYWVGLLYDEEALAAA

SEQ ID NO: 26763 - protein, 23 aa, Brucella spp.
PKPSELIYCFAPLKQGRLDYMVQ

SEQ ID NO: 26764 - protein, 30 aa, Brucella spp.
SEEERQLLHRLPFVTAIPLGPRILRADTAA

SEQ ID NO: 26765 - protein, 38 aa, Brucella spp.
GRVFLTLVMVVMAGLLGWHLWDYYMNAPWTRDGKIRAD

SEQ ID NO: 26766 - protein, 22 aa, Brucella spp.
FLAAFYSFAFLVTGFSGSSLAG

SEQ ID NO: 26767 - protein, 25 aa, Brucella spp.
GVRHTVFTMDLIYQEIRELAEIFNV

SEQ ID NO: 26768 - protein, 28 aa, Brucella spp.
LRPHIKTHKLPFFARMQVKAGAVGITCQ

SEQ ID NO: 26769 - protein, 28 aa, Brucella spp.
ADAGLTDIFLPYNILGQEKLDRLHALHR

SEQ ID NO: 26770 - protein, 27 aa, Brucella spp.
YRRHNDGWWYPLAAFGAGAIIGGAISQ

SEQ ID NO: 26771 - protein, 24 aa, Brucella spp.
RFGGFAGWNMPTTYPLGVMKEHLH

SEQ ID NO: 26772 - protein, 25 aa, Brucella spp.
TGQSKYTFFLNDNGGVLDDLIVTRL

SEQ ID NO: 26773 - protein, 17 aa, Brucella spp.
LDDLIVTRLGEDRFMVV

SEQ ID NO: 26774 - protein, 25 aa, Brucella spp.
AVKVNPLDRVFLALQGPEAEAVITD

SEQ ID NO: 26775 - protein, 24 aa, Brucella spp.
PGADLAFMSGFEPKQSWFMTRSGY

SEQ ID NO: 26776 - protein, 19 aa, Brucella spp.
KVPVDVHALPFTPHRYRKG

SEQ ID NO: 26777 - protein, 24 aa, Brucella spp.
AEGEGWLFKLKLADEGQLTGLLDK

SEQ ID NO: 26778 - protein, 24 aa, Brucella spp.
QEGVALMCLAEALLRIPDMATRDA

SEQ ID NO: 26779 - protein, 18 aa, Brucella spp.
LFVNAATWGLVVTGKLTN

SEQ ID NO: 26780 - protein, 28 aa, Brucella spp.
AYGKRCPLVLDFIIDLARRTKRRVMVRL

SEQ ID NO: 26781 - protein, 26 aa, Brucella spp.
ARRTKRRVMVRLVKGAYWDAEIKRAQ

SEQ ID NO: 26782 - protein, 17 aa, Brucella spp.
IFPQFATHNAQTLATIY

SEQ ID NO: 26783 - protein, 17 aa, Brucella spp.
LLAYLVRRLLENGANSS

SEQ ID NO: 26784 - protein, 26 aa, Brucella spp.
LERAADIMQRDMPALLGLVMREAGKS

SEQ ID NO: 26785 - protein, 23 aa, Brucella spp.
VREAIDFLRYYAEQTRRTLGVGH

SEQ ID NO: 26786 - protein, 34 aa, Brucella spp.
KALGPVVCISPWNFPLAIFTGQIAAALVAGNPVL

SEQ ID NO: 26787 - protein, 24 aa, Brucella spp.
IRVGNIYINRNIIGAVVGVQPFGG

SEQ ID NO: 26788 - protein, 22 aa, Brucella spp.
AGGPLYLGRLVETAPIPPRHAS

SEQ ID NO: 26789 - protein, 24 aa, Brucella spp.
ERNLYALHPRGRVLLVPQTEIGLY

SEQ ID NO: 26790 - protein, 22 aa, Brucella spp.
VPQTEIGLYRQLTAVLATGNTA

SEQ ID NO: 26791 - protein, 23 aa, Brucella spp.
QDAYCLNWLLEEVSTSINTTAAG

SEQ ID NO: 26792 - protein, 37 aa, Brucella spp.
GAPYGYEMYYLNVMAGPLRKWRFKNHPDHDWIFKRDN

SEQ ID NO: 26793 - protein, 17 aa, Brucella spp.
EGDTFIAGVWAIFGHGN

SEQ ID NO: 26794 - protein, 17 aa, Brucella spp.
DTFIAGVWAIFGHGNVA

SEQ ID NO: 26795 - protein, 17 aa, Brucella spp.
FIAGVWAIFGHGNVAGL

SEQ ID NO: 26796 - protein, 27 aa, Brucella spp.
LAHVNRLPVLFVPGDVFANRGPDPVLQ

SEQ ID NO: 26797 - protein, 34 aa, Brucella spp.
QAQAYDWPEEFFTPKVWHWRRPPPDERELETAAA

SEQ ID NO: 26798 - protein, 24 aa, Brucella spp.
AGKSALPWDHPLNFGPVGVTGADS

SEQ ID NO: 26799 - protein, 23 aa, Brucella spp.
TGSWALFRHPGRRLLSLNVQPYD

SEQ ID NO: 26800 - protein, 23 aa, Brucella spp.
PETGGWWWDVAVPEVSERDEVRA

SEQ ID NO: 26801 - protein, 18 aa, Brucella spp.
ALVILGIRDQQHFPLIFY

SEQ ID NO: 26802 - protein, 29 aa, Brucella spp.
LGIRDQQHFPLIFYRENCADMALCEDDID

SEQ ID NO: 26803 - protein, 18 aa, Brucella spp.
LQSTLHLFDLIVGTEEEF

SEQ ID NO: 26804 - protein, 17 aa, Brucella spp.
LFDLIVGTEEEFHIAGG

SEQ ID NO: 26805 - protein, 26 aa, Brucella spp.
YPSWEELQFFLQRGIRNKALRKDAEL

SEQ ID NO: 26806 - protein, 21 aa, Brucella spp.
TWPHMRVFAFDHRIQLEEMAA

SEQ ID NO: 26807 - protein, 34 aa, Brucella spp.
CGGLMEWPVEHVVKLLCFYHPDDPAEMRAGQEET

SEQ ID NO: 26808 - protein, 25 aa, Brucella spp.
ARRNRLEFLLEIIPSKAGPVDDMTT

SEQ ID NO: 26809 - protein, 36 aa, Brucella spp.
TTARVIERFYEIGVYPDWWKLEPLKTKAAWANACDA

SEQ ID NO: 26810 - protein, 27 aa, Brucella spp.
GVQSSAFMRFCQILGFSGFSEMQRLFR

SEQ ID NO: 26811 - protein, 27 aa, Brucella spp.
ASANTIHIIGIRRAFPVASYLAYALEK

SEQ ID NO: 26812 - protein, 24 aa, Brucella spp.
AIRKGDVLLAITFSPYSPETIGMT

SEQ ID NO: 26813 - protein, 20 aa, Brucella spp.
PLEAFFVPVSAATAALARLD

SEQ ID NO: 26814 - protein, 24 aa, Brucella spp.
ADLPPLLRAAIMHDAWFSLEVVQR

SEQ ID NO: 26815 - protein, 22 aa, Brucella spp.
QRSAWVGRLLTATFLRQSGLAA

SEQ ID NO: 26816 - protein, 29 aa, Brucella spp.
RSNSRLPQLMELILRTPLVSSQLVEKELQ

SEQ ID NO: 26817 - protein, 28 aa, Brucella spp.
SFPGKWKVIFFYPKDFTFVCPTEIAEFA

SEQ ID NO: 26818 - protein, 25 aa, Brucella spp.
MDEETTLHWHGLFVPSHLDGGPHNV

SEQ ID NO: 26819 - protein, 22 aa, Brucella spp.
QPASFNWFHPHLHGHTARQAHM

SEQ ID NO: 26820 - protein, 27 aa, Brucella spp.
AVYAPDIMDLIHGFRGDWLIVNGAIAP

SEQ ID NO: 26821 - protein, 17 aa, Brucella spp.
AAMVRLRLLNGANARNF

SEQ ID NO: 26822 - protein, 17 aa, Brucella spp.
MVRLRLLNGANARNFHI

SEQ ID NO: 26823 - protein, 26 aa, Brucella spp.
GANARNFHIRFADGRPLLVIASDGGF

SEQ ID NO: 26824 - protein, 23 aa, Brucella spp.
SGDGLHLMRFTVDPALEGRVAKP

SEQ ID NO: 26825 - protein, 23 aa, Brucella spp.
REMAHPFHIHGASFRILSMNGKK

SEQ ID NO: 26826 - protein, 24 aa, Brucella spp.
AARSHPFMFHCHLLEHEDVGMMAQ

SEQ ID NO: 26827 - protein, 21 aa, Brucella spp.
TMVLMAFPAFAESTTVKMYEA

SEQ ID NO: 26828 - protein, 25 aa, Brucella spp.
FDELNPVFWRRTAALLWAGVVIVAL

SEQ ID NO: 26829 - protein, 25 aa, Brucella spp.
EKAGLAAYYIPAVGGQLTQENVDDM

SEQ ID NO: 26830 - protein, 18 aa, Brucella spp.
QALRPLHPLEECSTTFTT

SEQ ID NO: 26831 - protein, 18 aa, Brucella spp.
THGAGFFRPGEGLFAVRE

SEQ ID NO: 26832 - protein, 18 aa, Brucella spp.
FFRPGEGLFAVREDIGRH

SEQ ID NO: 26833 - protein, 26 aa, Brucella spp.
VEMVQKAVMLGVPVLAAISAPTALAI

SEQ ID NO: 26834 - protein, 31 aa, Brucella spp.
GGFITTFLTWHWIFLINVPIGMIGIWFATHF

SEQ ID NO: 26835 - protein, 17 aa, Brucella spp.
IFRFGIGAIPFLLPLMF

SEQ ID NO: 26836 - protein, 29 aa, Brucella spp.
GIGAIPFLLPLMFQLGFGLTPFQSGMMTF

SEQ ID NO: 26837 - protein, 25 aa, Brucella spp.
TPATPYWIIIGFLLVGGFARSLFFT

SEQ ID NO: 26838 - protein, 27 aa, Brucella spp.
KSTLLRCINLLEIPTSGTLLLGGQSIT

SEQ ID NO: 26839 - protein, 30 aa, Brucella spp.
IRRQTGMVFQNFQLFPHQTAIQNVMEGLVT

SEQ ID NO: 26840 - protein, 23 aa, Brucella spp.
EVEYGLILASHAFSRWMVRCMAA

SEQ ID NO: 26841 - protein, 25 aa, Brucella spp.
SHAFSRWMVRCMAAAGLPGLSPIEI

SEQ ID NO: 26842 - protein, 25 aa, Brucella spp.
LPGLSPIEILILHSIRHRDREKKLA

SEQ ID NO: 26843 - protein, 22 aa, Brucella spp.
SELAALLRFMSGAFNQATRSAI

SEQ ID NO: 26844 - protein, 33 aa, Brucella spp.
IMGFDALYILIQTLVVFFFGAVQIDWLGPNARF

SEQ ID NO: 26845 - protein, 31 aa, Brucella spp.
LAETAIMVVFAGTLYYWLFSGAARSLHLIML

SEQ ID NO: 26846 - protein, 25 aa, Brucella spp.
SASLGILLVILFAPETPVFGKMLVA

SEQ ID NO: 26847 - protein, 25 aa, Brucella spp.
LAGTALFLRILRSIPLRSVLVVPLV

SEQ ID NO: 26848 - protein, 26 aa, Brucella spp.
VLRGRYELLWIAFALTVVAYVAADRF

SEQ ID NO: 26849 - protein, 18 aa, Brucella spp.
VVGSAIFLYLLLRRGSRL

SEQ ID NO: 26850 - protein, 19 aa, Brucella spp.
KERIAYIRRIAEIYESRLD

SEQ ID NO: 26851 - protein, 35 aa, Brucella spp.
VHEPIGVCGLITPWNWPMNQITLKVIPAIAVGCTV

SEQ ID NO: 26852 - protein, 27 aa, Brucella spp.
MTIAREEIFGPVLAMIPFDTEEEAIAI

SEQ ID NO: 26853 - protein, 27 aa, Brucella spp.
NEDERIELLALMWVGRGDFSATEWEEA

SEQ ID NO: 26854 - protein, 34 aa, Brucella spp.
QFAAGEMRPWLLSLGMRWFPVVGWAERGGSHAHG

SEQ ID NO: 26855 - protein, 24 aa, Brucella spp.
INGDRMWHYTEGLRNWNPIWPNHG

SEQ ID NO: 26856 - protein, 26 aa, Brucella spp.
GLRNWNPIWPNHGIRILPGPSSMWFD

SEQ ID NO: 26857 - protein, 28 aa, Brucella spp.
ILSTGYGYSWFILTEKIIRKEFSLSGSE

SEQ ID NO: 26858 - protein, 31 aa, Brucella spp.
MCLSAITWSGFDNFYYLFSHEDSRDAFSIPH

SEQ ID NO: 26859 - protein, 23 aa, Brucella spp.
YNRDNAFWHSHSIPKMVASLAEP

SEQ ID NO: 26860 - protein, 21 aa, Brucella spp.
VFDGHNDVLLRLWSSNQPEPE

SEQ ID NO: 26861 - protein, 17 aa, Brucella spp.
DVLLRLWSSNQPEPENR

SEQ ID NO: 26862 - protein, 17 aa, Brucella spp.
LLRLWSSNQPEPENRFL

SEQ ID NO: 26863 - protein, 24 aa, Brucella spp.
DADLDALYVLHAAGLRSLGPVWSR

SEQ ID NO: 26864 - protein, 17 aa, Brucella spp.
RSLGPVWSRPNIFAHGI

SEQ ID NO: 26865 - protein, 32 aa, Brucella spp.
LGPVWSRPNIFAHGIPFRFPSSPDIGPGLTDH

SEQ ID NO: 26866 - protein, 24 aa, Brucella spp.
HMNEKGFWDIAALSDAPLVASHSN

SEQ ID NO: 26867 - protein, 25 aa, Brucella spp.
LGAEGIRFFLDSALETVMDIRVQLS

SEQ ID NO: 26868 - protein, 26 aa, Brucella spp.
TSGAELLIDDLLPFADHPKVIGLAEF

SEQ ID NO: 26869 - protein, 24 aa, Brucella spp.
QGHLDYLIRTAIAGGVEPLAIYRA

SEQ ID NO: 26870 - protein, 32 aa, Brucella spp.
LGSVLEEPFLQLAFIALPVIPHLKITDRGLVD

SEQ ID NO: 26871 - protein, 26 aa, Brucella spp.
LGFLPILGFWMLPLGLIVLSHDSHRV

SEQ ID NO: 26872 - protein, 25 aa, Brucella spp.
PSNRDAICFPIRVLQIANDTGAERP

SEQ ID NO: 26873 - protein, 26 aa, Brucella spp.
LGAGHVRFFYARLGYLAKRQAALIAE

SEQ ID NO: 26874 - protein, 20 aa, Brucella spp.
PQFTNIEELLIGIPLEWRAD

SEQ ID NO: 26875 - protein, 25 aa, Brucella spp.
LDGQIDIVLLDVLMPGLDGFEVCRR

SEQ ID NO: 26876 - protein, 35 aa, Brucella spp.
LCTQLRTIQRTRLIPIILMVWEDEGALVVRALELG

SEQ ID NO: 26877 - protein, 23 aa, Brucella spp.
GVNDYLMRPLEKIELFARLRTQI

SEQ ID NO: 26878 - protein, 28 aa, Brucella spp.
GLHNRRYIDMHMPLLLTRAIERKQPLSI

SEQ ID NO: 26879 - protein, 33 aa, Brucella spp.
LSLWAHMAIWGPMTLIMSLLLLQPIKGSVIGLQ

SEQ ID NO: 26880 - protein, 22 aa, Brucella spp.
EGREDWREIPLITIDPADAKDH

SEQ ID NO: 26881 - protein, 26 aa, Brucella spp.
QKRGNSVYFPDRVVPMLPKRISNDLC

SEQ ID NO: 26882 - protein, 24 aa, Brucella spp.
KKSHKFHRIMMRSAAKVAYGQAQA

SEQ ID NO: 26883 - protein, 31 aa, Brucella spp.
DDKTGPILDTVLKPLWNAYAVLKRGRDAREP

SEQ ID NO: 26884 - protein, 27 aa, Brucella spp.
LEGRHQPLIFRIHGEPALAKQETLREF

SEQ ID NO: 26885 - protein, 25 aa, Brucella spp.
KQETLREFLRTLDLNLAKGAQLQPA

SEQ ID NO: 26886 - protein, 24 aa, Brucella spp.
IGHFGLHLRRYAHFTSPIRRYADL

SEQ ID NO: 26887 - protein, 25 aa, Brucella spp.
RRYADLIVHRALIKALGLGTDGLTS

SEQ ID NO: 26888 - protein, 17 aa, Brucella spp.
YMNVVVVESPAKAKTIN

SEQ ID NO: 26889 - protein, 36 aa, Brucella spp.
YLARRALDYLVGFTLSPVLWRKLPGARSAGRVQSVA

SEQ ID NO: 26890 - protein, 28 aa, Brucella spp.
AEIERFVREEYWNIAALLKTPRNDSFTA

SEQ ID NO: 26891 - protein, 28 aa, Brucella spp.
DEDQARLYELIWKRAIASQMQAADIERT

SEQ ID NO: 26892 - protein, 24 aa, Brucella spp.
LRDREYIIIDKRKLIPEAKGRLVT

SEQ ID NO: 26893 - protein, 25 aa, Brucella spp.
LVTAFLESFFERYVEYDFTADLEEK

SEQ ID NO: 26894 - protein, 29 aa, Brucella spp.
GKLSWKEILRDFWRAFSGSVEDIKELRVT

SEQ ID NO: 26895 - protein, 20 aa, Brucella spp.
QAQNPMLVYLLEMAQEEARD

SEQ ID NO: 26896 - protein, 27 aa, Brucella spp.
LSDRQRLNWLRLIRTDNIGAVTFRDLI

SEQ ID NO: 26897 - protein, 20 aa, Brucella spp.
AVTFRDLILFCGSASNALEM

SEQ ID NO: 26898 - protein, 24 aa, Brucella spp.
DFPRRNRIIAGLSLGLIVVEAAER

SEQ ID NO: 26899 - protein, 28 aa, Brucella spp.
IETDAIQLILLELDLAGRLLRYPGNRVA

SEQ ID NO: 26900 - protein, 20 aa, Brucella spp.
LFPHRHLLGIKGLSPLDILC

SEQ ID NO: 26901 - protein, 24 aa, Brucella spp.
LSPLDILCLLDLADQEIAVSRQPE

SEQ ID NO: 26902 - protein, 25 aa, Brucella spp.
RVARSNILLLNALGARVRVVAPSTL

SEQ ID NO: 26903 - protein, 27 aa, Brucella spp.
FVPSVREYFHFYGLDREKLKFAKPDAL

SEQ ID NO: 26904 - protein, 25 aa, Brucella spp.
AYLGDPLLMQIAARFPKELHTELEQ

SEQ ID NO: 26905 - protein, 23 aa, Brucella spp.
GRRIDLVEYHPAYHALMRRSVAQ

SEQ ID NO: 26906 - protein, 28 aa, Brucella spp.
AWRLTGHKWFMSAPMSDAFLTLAQTKEG

SEQ ID NO: 26907 - protein, 24 aa, Brucella spp.
KGESNGFFFQRLKDKLGNRSNASS

SEQ ID NO: 26908 - protein, 23 aa, Brucella spp.
LVEQPLMQRVLADMALDVAGATA

SEQ ID NO: 26909 - protein, 29 aa, Brucella spp.
RSMTPVVKYWVCKIAPALLYEAMECLGGN

SEQ ID NO: 26910 - protein, 25 aa, Brucella spp.
VETAKAVILIDPFLNGNPGAKGIDF

SEQ ID NO: 26911 - protein, 25 aa, Brucella spp.
GNPNGLVFHFEDSPTLYHMGDTDIF

SEQ ID NO: 26912 - protein, 25 aa, Brucella spp.
ALACQRYFNFNSVLPCHYASFPIID

SEQ ID NO: 26913 - protein, 25 aa, Brucella spp.
ERMTGELNAILGFVEQLNEVDVEGI

SEQ ID NO: 26914 - protein, 30 aa, Brucella spp.
IVDISLPHTKYALPAYYIVAPAEASSNLAR

SEQ ID NO: 26915 - protein, 27 aa, Brucella spp.
GKEVKRRIMIGTYVLSAGYYDAYYLRA

SEQ ID NO: 26916 - protein, 25 aa, Brucella spp.
LSAGYYDAYYLRAQKVRTLIKKDFE

SEQ ID NO: 26917 - protein, 28 aa, Brucella spp.
LANDPVKMYLNDIFTVTVNMAGLPGIAV

SEQ ID NO: 26918 - protein, 19 aa, Brucella spp.
FDPHRLYRMARSKAYLFGG

SEQ ID NO: 26919 - protein, 25 aa, Brucella spp.
ETPEKAVFHFPGGLKDYLEASLGKE

SEQ ID NO: 26920 - protein, 46 aa, Brucella spp.
VDGAHIASLLITFFYQEMPELIRNGHLYLAVPPLYRLSQGGKTAYA

SEQ ID NO: 26921 - protein, 35 aa, Brucella spp.
PATATFMRFFVQCWLMFFIILVVGGLRALATSHLM

SEQ ID NO: 26922 - protein, 26 aa, Brucella spp.
EGTASELVWLVEHPPLYTAGTSANAE

SEQ ID NO: 26923 - protein, 26 aa, Brucella spp.
FVASLEQWIIETLAAFNIKGERREDR

SEQ ID NO: 26924 - protein, 27 aa, Brucella spp.
IAAIGIRLRRWVSFHGIAINVEPDLSH

SEQ ID NO: 26925 - protein, 25 aa, Brucella spp.
HLPDNPIVFANPAFLKLTGYEADEV

SEQ ID NO: 26926 - protein, 23 aa, Brucella spp.
KSGEAFWNRLHISPVHNANGRLQ

SEQ ID NO: 26927 - protein, 25 aa, Brucella spp.
QLDYIVEVANIGFWTREFYSGKMTC

SEQ ID NO: 26928 - protein, 26 aa, Brucella spp.
FTPDEPVHFDTILDLVVLEDRMTVVQ

SEQ ID NO: 26929 - protein, 25 aa, Brucella spp.
FAASGLLIDVLAPITPEVFPGMGHN

SEQ ID NO: 26930 - protein, 17 aa, Brucella spp.
IVLGLALVCAAGIYASL

SEQ ID NO: 26931 - protein, 26 aa, Brucella spp.
AMLARNIIVMPVELGPWRAALDKEDG

SEQ ID NO: 26932 - protein, 24 aa, Brucella spp.
RGLDLGVYFHPVLTGIGQGATIAY

SEQ ID NO: 26933 - protein, 18 aa, Brucella spp.
GVDSLRYFWSERTPEEIA

SEQ ID NO: 26934 - protein, 17 aa, Brucella spp.
YFWSERTPEEIANDTTA

SEQ ID NO: 26935 - protein, 26 aa, Brucella spp.
SFGADTFPFAWKYLDPSIQDRTRMVG

SEQ ID NO: 26936 - protein, 18 aa, Brucella spp.
SFLSPCVLPLVPPYLCYM

SEQ ID NO: 26937 - protein, 17 aa, Brucella spp.
CVLPLVPPYLCYMAGVS

SEQ ID NO: 26938 - protein, 26 aa, Brucella spp.
IVAGVVIILMGLNFLGLLRLSFLSRE

SEQ ID NO: 26939 - protein, 22 aa, Brucella spp.
GLGIPFLIAALFSGAFMRFLSR

SEQ ID NO: 26940 - protein, 27 aa, Brucella spp.
GEPKIGQLLFLPPHSIIDRRNRPGIAF

SEQ ID NO: 26941 - protein, 30 aa, Brucella spp.
DDTGEIALTFFHAQLPWLQKMLPEGETVIV

SEQ ID NO: 26942 - protein, 19 aa, Brucella spp.
LVMTATPIPRTLVLTAFGD

SEQ ID NO: 26943 - protein, 23 aa, Brucella spp.
SEDQKIYWICPLVEESEVVELTS

SEQ ID NO: 26944 - protein, 18 aa, Brucella spp.
TCLLLYKGPLGEIAQARL

SEQ ID NO: 26945 - protein, 29 aa, Brucella spp.
LGFVSPDLPVLHLPAWDCLPYDRVSPGAD

SEQ ID NO: 26946 - protein, 22 aa, Brucella spp.
EPLRLDFFGDTLETIRAFDPAS

SEQ ID NO: 26947 - protein, 33 aa, Brucella spp.
SEGRRFAGMEHWLPLFYDNMETVFDHAGPMPVV

SEQ ID NO: 26948 - protein, 18 aa, Brucella spp.
KPVKPEMLYLTPGQVEEA

SEQ ID NO: 26949 - protein, 25 aa, Brucella spp.
YAGDDRLFLPVENIELLSRYGSEGS

SEQ ID NO: 26950 - protein, 17 aa, Brucella spp.
IKFKNLGLLIIDEEQHF

SEQ ID NO: 26951 - protein, 23 aa, Brucella spp.
VDRMAVRTFVSPFDPLVIRETLL

SEQ ID NO: 26952 - protein, 17 aa, Brucella spp.
SPFDPLVIRETLLRERY

SEQ ID NO: 26953 - protein, 23 aa, Brucella spp.
GGQSFYVVPRIADLTDIEEFLKE

SEQ ID NO: 26954 - protein, 24 aa, Brucella spp.
TANTMIVHRADMFGLAQLYQLRGR

SEQ ID NO: 26955 - protein, 26 aa, Brucella spp.
RSKQRAFALFTLPAGKMLTQMAERRL

SEQ ID NO: 26956 - protein, 26 aa, Brucella spp.
MIPEAYVPDLQLRLGLYRRLADLEEP

SEQ ID NO: 26957 - protein, 24 aa, Brucella spp.
PDEVQHLLKIVYIKALCRRANVEK

SEQ ID NO: 26958 - protein, 27 aa, Brucella spp.
IRPDQSIVFIRDWPTPEKRLNGSAVIM

SEQ ID NO: 26959 - protein, 27 aa, Brucella spp.
FSLSKERFFLIGNGKEPIWIATMEGEP

SEQ ID NO: 26960 - protein, 23 aa, Brucella spp.
NGKEPIWIATMEGEPLPTRTNNH

SEQ ID NO: 26961 - protein, 20 aa, Brucella spp.
VVCPWCFLGRKRLEAALASL

SEQ ID NO: 26962 - protein, 27 aa, Brucella spp.
PDVEAEIRWRPFQLDPTLPPHGKDRQT

SEQ ID NO: 26963 - protein, 18 aa, Brucella spp.
GEEYGIVFDFDAIIRAPN

SEQ ID NO: 26964 - protein, 18 aa, Brucella spp.
GIVFDFDAIIRAPNTLDA

SEQ ID NO: 26965 - protein, 25 aa, Brucella spp.
PDTQDRMVGMLFSLYFEQGQDIGNH

SEQ ID NO: 26966 - protein, 28 aa, Brucella spp.
ASDGRYTAMWWWLGLALFVDGIDGPIAR

SEQ ID NO: 26967 - protein, 19 aa, Brucella spp.
PVVWNMVVFTLFIVRPGEW

SEQ ID NO: 26968 - protein, 26 aa, Brucella spp.
RPLNLTIFLLWCAFGVIALYYMLDAP

SEQ ID NO: 26969 - protein, 24 aa, Brucella spp.
SVTGLYIYFIGAIMQLFPSLGREA

SEQ ID NO: 26970 - protein, 27 aa, Brucella spp.
AEEKLKVGFIYIGPPGDFGWTYQHDQA

SEQ ID NO: 26971 - protein, 24 aa, Brucella spp.
RAGNKLIFTTSFGYMDPTVKVTKK

SEQ ID NO: 26972 - protein, 28 aa, Brucella spp.
QSVNPDFRVKVIWVNSWFDPGKEADAAK

SEQ ID NO: 26973 - protein, 27 aa, Brucella spp.
GTWKSQNIWWGMKEGLVKMAPFTNMPD

SEQ ID NO: 26974 - protein, 19 aa, Brucella spp.
QTLLGMNFYVAGVDDKLPQ

SEQ ID NO: 26975 - protein, 31 aa, Brucella spp.
ELGEMGVWVRMHYVYPYPHVDEVIPLMAEGK

SEQ ID NO: 26976 - protein, 29 aa, Brucella spp.
LMAEGKILPYLDIPFQHASPAVLKNMRRP

SEQ ID NO: 26977 - protein, 24 aa, Brucella spp.
TEEDFQMLLDWLDEAKIERAGCFK

SEQ ID NO: 26978 - protein, 27 aa, Brucella spp.
LGAVNQYWLHYRLLNDWGYTRLAKKER

SEQ ID NO: 26979 - protein, 26 aa, Brucella spp.
ADKLINRIIFFEGFPNLQTVSPLRIG

SEQ ID NO: 26980 - protein, 27 aa, Brucella spp.
AYNVSELFLFKILQPLVEHGLVETVRG

SEQ ID NO: 26981 - protein, 33 aa, Brucella spp.
PVGGVCPFGLPGALPVFCDISLKTYDEVVPAAG

SEQ ID NO: 26982 - protein, 21 aa, Brucella spp.
LGGQWYVFRHNPVQKDDEARK

SEQ ID NO: 26983 - protein, 28 aa, Brucella spp.
RERGRSLLITIEPWSWARDWRVGPEDLL

SEQ ID NO: 26984 - protein, 27 aa, Brucella spp.
EDDAGQFTWAFWKPEGYVKAYRHVIDV

SEQ ID NO: 26985 - protein, 26 aa, Brucella spp.
IAVLERGILPIYEPGLDELVERNCAE

SEQ ID NO: 26986 - protein, 25 aa, Brucella spp.
AVRGAEMVFIAVGTPPRAGHGDADL

SEQ ID NO: 26987 - protein, 24 aa, Brucella spp.
DADLSFVYMAARELAPLIDENAVV

SEQ ID NO: 26988 - protein, 18 aa, Brucella spp.
ASNPEFLREGVAIRDFLY

SEQ ID NO: 26989 - protein, 28 aa, Brucella spp.
EFLREGVAIRDFLYPDRVVIGVEDERAR

SEQ ID NO: 26990 - protein, 18 aa, Brucella spp.
SRVRQAMRQPVLIDLRNA

SEQ ID NO: 26991 - protein, 18 aa, Brucella spp.
AMRQPVLIDLRNAYEPNV

SEQ ID NO: 26992 - protein, 19 aa, Brucella spp.
TLFHDFHQQYGVDIRIVRI

SEQ ID NO: 26993 - protein, 24 aa, Brucella spp.
GVDIRIVRIFNTYGPRMRPDDGRV

SEQ ID NO: 26994 - protein, 22 aa, Brucella spp.
IEGFHRLMYSPHAIRVPVNIGN

SEQ ID NO: 26995 - protein, 24 aa, Brucella spp.
GSRSRIVYYPLPVDDPRQRRPDIT

SEQ ID NO: 26996 - protein, 31 aa, Brucella spp.
PARGQRWIKVDDQFLLITAATGLIVGVLAGR

SEQ ID NO: 26997 - protein, 26 aa, Brucella spp.
FEFDGKLHHLGILALTNFGRAGDLVL

SEQ ID NO: 26998 - protein, 29 aa, Brucella spp.
DHDEPNDFIPMMILNENRIDTLFRAAAEA

SEQ ID NO: 26999 - protein, 23 aa, Brucella spp.
AADEFHRLTTFAAKSPLGITTQN

SEQ ID NO: 27000 - protein, 17 aa, Brucella spp.
WKDGIVHRLNSGVAGLL

SEQ ID NO: 27001 - protein, 23 aa, Brucella spp.
LKRSRVRMFQGQARFQDGKTVLV

SEQ ID NO: 27002 - protein, 23 aa, Brucella spp.
EATDRILPQYDAELTRPVMARLK

SEQ ID NO: 27003 - protein, 19 aa, Brucella spp.
ELTRPVMARLKTLGVEVLT

SEQ ID NO: 27004 - protein, 24 aa, Brucella spp.
GWGLSEIRLDMDGRFIRIDDRCRT

SEQ ID NO: 27005 - protein, 23 aa, Brucella spp.
YGLRPCIEVQFADYVYPAYDQIV

SEQ ID NO: 27006 - protein, 24 aa, Brucella spp.
EFTCPIVIRMPSGGGIYGGQTHSQ

SEQ ID NO: 27007 - protein, 26 aa, Brucella spp.
IEDPDPVIMFEPKRLYNGPFDGHHDK

SEQ ID NO: 27008 - protein, 26 aa, Brucella spp.
GVDAEVIDLRTLLPLDTETIMASVKK

SEQ ID NO: 27009 - protein, 26 aa, Brucella spp.
ALVQRDCFYHLEAPIMRVTGWGTPYP

SEQ ID NO: 27010 - protein, 32 aa, Brucella spp.
ANGRKLVIGYILRHHLSWMRLIEEARKLGGPY

SEQ ID NO: 27011 - protein, 18 aa, Brucella spp.
DEIKPDMYNYGHLQVLFD

SEQ ID NO: 27012 - protein, 25 aa, Brucella spp.
KPDMYNYGHLQVLFDDGTVGWYEAG

SEQ ID NO: 27013 - protein, 26 aa, Brucella spp.
LVHATLIFYMLIAVFPVALTLINSFK

SEQ ID NO: 27014 - protein, 24 aa, Brucella spp.
GMSEYAIFFKLVLPLIRPAMATVA

SEQ ID NO: 27015 - protein, 25 aa, Brucella spp.
VAVFTMIPIWNDLWFPLILAPSEAT

SEQ ID NO: 27016 - protein, 28 aa, Brucella spp.
AALSLAMFPILILYVLFSRQLIRGITAG

SEQ ID NO: 27017 - protein, 25 aa, Brucella spp.
LKNNVIFFLIHMLVQNPIGIFLAAM

SEQ ID NO: 27018 - protein, 26 aa, Brucella spp.
SFVIVGFIWKLILSPIWGVAPWMMDL

SEQ ID NO: 27019 - protein, 20 aa, Brucella spp.
WQFVGIPMMLIYAALLNIPE

SEQ ID NO: 27020 - protein, 17 aa, Brucella spp.
IPMMLIYAALLNIPEEI

SEQ ID NO: 27021 - protein, 17 aa, Brucella spp.
MMLIYAALLNIPEEIVE

SEQ ID NO: 27022 - protein, 23 aa, Brucella spp.
ILGTFLYRTFFGFQLQLGNPSMG

SEQ ID NO: 27023 - protein, 24 aa, Brucella spp.
IAAVMFLIILAGVSLYLFGIQRRM

SEQ ID NO: 27024 - protein, 29 aa, Brucella spp.
SFSGFYLAMFVILFALILRPVGFKFRSKR

SEQ ID NO: 27025 - protein, 35 aa, Brucella spp.
SSSHQTLFIMLVVTVVFIPIIVAYTAWVYKVLWGK

SEQ ID NO: 27026 - protein, 28 aa, Brucella spp.
QFAITALYHFLFVPLTLGLSVLLAIMET

SEQ ID NO: 27027 - protein, 30 aa, Brucella spp.
EGMMAFFLEATFVGLFFFGWDRLSKVGHLV

SEQ ID NO: 27028 - protein, 39 aa, Brucella spp.
TVPGVLPLFWAFRIMVGIGFFLILLTGTFFVLSARRALD

SEQ ID NO: 27029 - protein, 25 aa, Brucella spp.
FVVIYTVLFIIEMGLMLRAIKAGPE

SEQ ID NO: 27030 - protein, 23 aa, Brucella spp.
PVLRLFFRSRAVALYAGIAAATI

SEQ ID NO: 27031 - protein, 23 aa, Brucella spp.
KRPARLLFRLTADIDALDSLYLR

SEQ ID NO: 27032 - protein, 25 aa, Brucella spp.
DALDSLYLRVLVPIGAALATALFAG

SEQ ID NO: 27033 - protein, 30 aa, Brucella spp.
AGVALGFMHPLFGLLVALTLLVIGLGLPVI

SEQ ID NO: 27034 - protein, 22 aa, Brucella spp.
VAVLGILIILGAMEPFAALRRG

SEQ ID NO: 27035 - protein, 25 aa, Brucella spp.
QARRLALARLFLTDAPLWELDEPTE

SEQ ID NO: 27036 - protein, 17 aa, Brucella spp.
ICNRIIVLNQGALILSV

SEQ ID NO: 27037 - protein, 17 aa, Brucella spp.
IIVLNQGALILSVRKGE

SEQ ID NO: 27038 - protein, 18 aa, Brucella spp.
LWAAILVSFLLVAGAFLT

SEQ ID NO: 27039 - protein, 25 aa, Brucella spp.
ILLASIIFFSILQSKPILHEVLITV

SEQ ID NO: 27040 - protein, 25 aa, Brucella spp.
LLFVSLVLFWLLLNSFTRAQFILGL

SEQ ID NO: 27041 - protein, 25 aa, Brucella spp.
HIRSPRMMIWLLYAASIDVLRSNIA

SEQ ID NO: 27042 - protein, 29 aa, Brucella spp.
HKASPHFHTIFQLLLMGLNGAFLTGDLFN

SEQ ID NO: 27043 - protein, 26 aa, Brucella spp.
TGDLFNLFVFFEVMLAASYGLALHGS

SEQ ID NO: 27044 - protein, 27 aa, Brucella spp.
AFLIKAGMWPLNFWLAPAYTAAAAPVA

SEQ ID NO: 27045 - protein, 25 aa, Brucella spp.
IMSKVGIYVLLRLSPLMFGISAGSS

SEQ ID NO: 27046 - protein, 24 aa, Brucella spp.
GFGNDWLYFGGMITLAFGLIGVVA

SEQ ID NO: 27047 - protein, 23 aa, Brucella spp.
MASGVWLILRPRTFQVAIGLSLV

SEQ ID NO: 27048 - protein, 22 aa, Brucella spp.
IVIGFAMTALFLVVLLASRGLT

SEQ ID NO: 27049 - protein, 24 aa, Brucella spp.
DKIAELMVQIESVKPKPLVEELFT

SEQ ID NO: 27050 - protein, 27 aa, Brucella spp.
AEEARAIYNLPFNDLLFRAHGLHRENF

SEQ ID NO: 27051 - protein, 23 aa, Brucella spp.
AEDRIDMLVTLANLPEPPESVPI

SEQ ID NO: 27052 - protein, 27 aa, Brucella spp.
EPPESVPINMLIPMPGTRLAKAAPVDP

SEQ ID NO: 27053 - protein, 25 aa, Brucella spp.
APVDPLEFVRVVALARILMPKSHVR

SEQ ID NO: 27054 - protein, 25 aa, Brucella spp.
SDEMQALCFFAGANSLFMGDTLLTA

SEQ ID NO: 27055 - protein, 28 aa, Brucella spp.
AAHFSAPRMIYFGSGYMANLAALSTLPQ

SEQ ID NO: 27056 - protein, 22 aa, Brucella spp.
GRGTPWIVVESIYSMDGDQAPL

SEQ ID NO: 27057 - protein, 25 aa, Brucella spp.
LVNRASGFIFTTAPSPLQAAALREA

SEQ ID NO: 27058 - protein, 19 aa, Brucella spp.
PVSGTQIIPIIVGDNERAV

SEQ ID NO: 27059 - protein, 17 aa, Brucella spp.
IIPIIVGDNERAVRLAA

SEQ ID NO: 27060 - protein, 23 aa, Brucella spp.
HGTARLRISITLNVGLADIDRMV

SEQ ID NO: 27061 - protein, 17 aa, Brucella spp.
WHPFTQHRLEPRPDRIV

SEQ ID NO: 27062 - protein, 25 aa, Brucella spp.
SAVLDMISSWWVITHGHRHPAIMDA

SEQ ID NO: 27063 - protein, 24 aa, Brucella spp.
NAAYGALLFNVETLPFPSPGHEQP

SEQ ID NO: 27064 - protein, 34 aa, Brucella spp.
AGPKLRTFFKQNGVLLRPLGNVIYVMPPYCVTAE

SEQ ID NO: 27065 - protein, 27 aa, Brucella spp.
DAVRQDIRPLRIGLLNLMPNKVTTETQ

SEQ ID NO: 27066 - protein, 23 aa, Brucella spp.
HRTLNICWAAQAAVYHFHGMKKY

SEQ ID NO: 27067 - protein, 27 aa, Brucella spp.
ENRWRSHAHLLFGNWINEMYQSTPYDI

SEQ ID NO: 27068 - protein, 39 aa, Brucella spp.
NNVFWNYVLVYGLLAVGLFFTIRLKFVQFVHFPELFRVV

SEQ ID NO: 27069 - protein, 27 aa, Brucella spp.
LGGPGAIFWMWIVALVGLATAYSESAL

SEQ ID NO: 27070 - protein, 26 aa, Brucella spp.
AEVVVPFMAFAYILMAICILAINFQA

SEQ ID NO: 27071 - protein, 25 aa, Brucella spp.
YFIAAAIFFFAFTSIIGNYSYAESA

SEQ ID NO: 27072 - protein, 24 aa, Brucella spp.
PQDGYRVLVDRVWPRGMTKEKARI

SEQ ID NO: 27073 - protein, 24 aa, Brucella spp.
PSTELRKWFGHDPAKWGDFQKKYR

SEQ ID NO: 27074 - protein, 38 aa, Brucella spp.
KYIRGGFAILIGLLGVFIILWAWQLPPFKHSVETTDNA

SEQ ID NO: 27075 - protein, 22 aa, Brucella spp.
SFYILLTLVTIAFAWLLIPYYT

SEQ ID NO: 27076 - protein, 25 aa, Brucella spp.
VTIAFAWLLIPYYTAVLWAVIMAVI

SEQ ID NO: 27077 - protein, 24 aa, Brucella spp.
AVIMAVIFYPVQQWLVLLLRGRRN

SEQ ID NO: 27078 - protein, 33 aa, Brucella spp.
FGQNTLQFFIGFGIMLYLLFFLFRDGADVGKKI

SEQ ID NO: 27079 - protein, 18 aa, Brucella spp.
GGITFWLLGIEAALLWGV

SEQ ID NO: 27080 - protein, 17 aa, Brucella spp.
WLLGIEAALLWGVIMTF

SEQ ID NO: 27081 - protein, 32 aa, Brucella spp.
PGTGEYLYNKEPGIYVDIVSGEPLFASSDKYE

SEQ ID NO: 27082 - protein, 26 aa, Brucella spp.
VDRGGLRYCINSASLRFVPKDRMEAE

SEQ ID NO: 27083 - protein, 25 aa, Brucella spp.
AKWPEVELFLTEMNTNLLIERLVRG

SEQ ID NO: 27084 - protein, 27 aa, Brucella spp.
ALAGEPFVLFPRIVGLSLYDDIAAACR

SEQ ID NO: 27085 - protein, 26 aa, Brucella spp.
CFGTIDSWLIYKLTGGKAHVTDATNA

SEQ ID NO: 27086 - protein, 18 aa, Brucella spp.
RWDDELLDILGIPAAMLP

SEQ ID NO: 27087 - protein, 27 aa, Brucella spp.
ADPNQRIYLVPAFTGLGAPYWDAEARG

SEQ ID NO: 27088 - protein, 24 aa, Brucella spp.
PVDRPVFLETTVLGAAWLAASRAG

SEQ ID NO: 27089 - protein, 23 aa, Brucella spp.
SITRHLRAALLSSALLLATGGLA

SEQ ID NO: 27090 - protein, 26 aa, Brucella spp.
KAPGKYEFRPGMVALELMALGGGAGK

SEQ ID NO: 27091 - protein, 29 aa, Brucella spp.
QISSADMRRKLIFTISRNVNGAYQEIAAN

SEQ ID NO: 27092 - protein, 30 aa, Brucella spp.
DLLETIKRRKLMLTLPIIAGVGVGFAGYLT

SEQ ID NO: 27093 - protein, 27 aa, Brucella spp.
SNDGRSFTIFISYRAPDPVYAARVANA

SEQ ID NO: 27094 - protein, 29 aa, Brucella spp.
MAKASPRLINWLLVGLGLGGLFAVAGTML

SEQ ID NO: 27095 - protein, 30 aa, Brucella spp.
GELIAQLRPDHRIILVNLPSYAEDKRSALM

SEQ ID NO: 27096 - protein, 32 aa, Brucella spp.
STEKDQLYEVERPLLVIIDSRALDRECLAHGL

SEQ ID NO: 27097 - protein, 24 aa, Brucella spp.
PDAKSPIIFDTAYVYDPGSDGWSK

SEQ ID NO: 27098 - protein, 22 aa, Brucella spp.
ASTLPVIGLIKRDLDDSPVRIT

SEQ ID NO: 27099 - protein, 17 aa, Brucella spp.
AHCSRLGSFLIAEGRYN

SEQ ID NO: 27100 - protein, 18 aa, Brucella spp.
IPPDYPLGRRMGAALGAP

SEQ ID NO: 27101 - protein, 25 aa, Brucella spp.
AARGRDMVFLTISSGIGGGIVLGGR

SEQ ID NO: 27102 - protein, 23 aa, Brucella spp.
AGPSGFVRLETLASGFGIAKMAL

SEQ ID NO: 27103 - protein, 24 aa, Brucella spp.
AGEGWARRILLDAASQLAAAVAGL

SEQ ID NO: 27104 - protein, 31 aa, Brucella spp.
LAATGGFTWLVTYFEPLVIYDDKLENIVGDL

SEQ ID NO: 27105 - protein, 24 aa, Brucella spp.
DTLTKVMMLPEHALASIPPEQLAK

SEQ ID NO: 27106 - protein, 25 aa, Brucella spp.
NGSKPITILTYYNSPLVANVLAAMQ

SEQ ID NO: 27107 - protein, 22 aa, Brucella spp.
SKLENFIWTPAPAGGPYQAHPE

SEQ ID NO: 27108 - protein, 17 aa, Brucella spp.
QNRAAIFGLVLLTPLLF

SEQ ID NO: 27109 - protein, 32 aa, Brucella spp.
RAAIFGLVLLTPLLFAVLTYPLWLPYKPNDID

SEQ ID NO: 27110 - protein, 19 aa, Brucella spp.
AMTLPPVIFLLVLASIIGS

SEQ ID NO: 27111 - protein, 26 aa, Brucella spp.
AVLEQFPWQWLFPGGALVLAVLAINF

SEQ ID NO: 27112 - protein, 27 aa, Brucella spp.
EMAALARRLILEGVPMLIEKPVGVSGA

SEQ ID NO: 27113 - protein, 26 aa, Brucella spp.
FVSVALPYCFSPLLAEADALRDTNRL

SEQ ID NO: 27114 - protein, 23 aa, Brucella spp.
AISHSHFRLINGPPQRYVNDGVA

SEQ ID NO: 27115 - protein, 26 aa, Brucella spp.
PAVTLRDLWRAMDLIDRCYALSAKRS

SEQ ID NO: 27116 - protein, 17 aa, Brucella spp.
QLVERYFEPERIKAFEP

SEQ ID NO: 27117 - protein, 36 aa, Brucella spp.
DLVTQFAQLYAVRIQCAFLGWPDSLQGPLLDWVHKN

SEQ ID NO: 27118 - protein, 22 aa, Brucella spp.
AAIDEILRLHAPLISNRRVTTR

SEQ ID NO: 27119 - protein, 24 aa, Brucella spp.
ARAGLRILMEELLGQTRKLDLVPG

SEQ ID NO: 27120 - protein, 28 aa, Brucella spp.
NLEAIERLSIFAPLHQPKSLALIKAVRK

SEQ ID NO: 27121 - protein, 32 aa, Brucella spp.
QPKSLALIKAVRKIFPHLAQTASFDTAFHQTI

SEQ ID NO: 27122 - protein, 17 aa, Brucella spp.
LDPGVLLHLLQQEKMEA

SEQ ID NO: 27123 - protein, 20 aa, Brucella spp.
PGVLLHLLQQEKMEADALAD

SEQ ID NO: 27124 - protein, 24 aa, Brucella spp.
DALADLLYHRSGLLGLSGLSGDTR

SEQ ID NO: 27125 - protein, 24 aa, Brucella spp.
AHTALDIFALRIAGEICRLASTLN

SEQ ID NO: 27126 - protein, 17 aa, Brucella spp.
SETFEIIRQMPATARSA

SEQ ID NO: 27127 - protein, 22 aa, Brucella spp.
LSLINRYWRAANYLSVGQIYLM

SEQ ID NO: 27128 - protein, 22 aa, Brucella spp.
SVGQIYLMKNPLLREPLQPEHI

SEQ ID NO: 27129 - protein, 25 aa, Brucella spp.
GTTPGLNFIYAHLNRIIQQRNANVI

SEQ ID NO: 27130 - protein, 23 aa, Brucella spp.
AGMERLFRQFSFPGGIPSHAAPE

SEQ ID NO: 27131 - protein, 28 aa, Brucella spp.
HSPERPRWPMIILRSPKGWTGPKTVDGL

SEQ ID NO: 27132 - protein, 21 aa, Brucella spp.
GFFSCYEAFIHIIDSMFNQHA

SEQ ID NO: 27133 - protein, 24 aa, Brucella spp.
VARELEWRKPISSLNYLLTSHVWR

SEQ ID NO: 27134 - protein, 25 aa, Brucella spp.
SADIARVYFPPDANTLLWVGDHCLK

SEQ ID NO: 27135 - protein, 17 aa, Brucella spp.
LPHLRIRVVNVVDLMVL

SEQ ID NO: 27136 - protein, 19 aa, Brucella spp.
HLRIRVVNVVDLMVLQSPH

SEQ ID NO: 27137 - protein, 35 aa, Brucella spp.
MFTTNRPVIFAYHGYPYLIHRLVYKRTNHSNFHVR

SEQ ID NO: 27138 - protein, 19 aa, Brucella spp.
FFRITEVMLLFLAGSLLLT

SEQ ID NO: 27139 - protein, 20 aa, Brucella spp.
ALMVPLSLALAYGAQAKEIP

SEQ ID NO: 27140 - protein, 25 aa, Brucella spp.
FAEGDWVPYLVVSYELTHLDNGKVQ

SEQ ID NO: 27141 - protein, 22 aa, Brucella spp.
TGVGPWFKPVTAEYEFVYAGTG

SEQ ID NO: 27142 - protein, 29 aa, Brucella spp.
AEYGRHLAKLFTPLMIGVGPVEAAVNLAS

SEQ ID NO: 27143 - protein, 25 aa, Brucella spp.
EKGVTPFLDLPETVELPFRVAGIDT

SEQ ID NO: 27144 - protein, 25 aa, Brucella spp.
YAALTLMPADAAVLTIEFKVNLLAP

SEQ ID NO: 27145 - protein, 21 aa, Brucella spp.
AVLTIEFKVNLLAPGKGERFL

SEQ ID NO: 27146 - protein, 23 aa, Brucella spp.
GKGERFLFRGEVTKPGRTIMVSD

SEQ ID NO: 27147 - protein, 28 aa, Brucella spp.
GNLFAPLQFLYLIAMLFVLAGILTAAMV

SEQ ID NO: 27148 - protein, 28 aa, Brucella spp.
SMVLALYWLFMCWRLQRSTWLQSLCNAV

SEQ ID NO: 27149 - protein, 28 aa, Brucella spp.
LVGNNTPVFFVRDPLKFPDFIHTQKRHP

SEQ ID NO: 27150 - protein, 27 aa, Brucella spp.
HLRSATAMWDFWSLSPESLHQVTILMS

SEQ ID NO: 27151 - protein, 20 aa, Brucella spp.
ERYWVKFHFKTMQGHKHWTN

SEQ ID NO: 27152 - protein, 17 aa, Brucella spp.
QPRALFNLFDAAQKQRL

SEQ ID NO: 27153 - protein, 17 aa, Brucella spp.
FNLFDAAQKQRLFSNIA

SEQ ID NO: 27154 - protein, 21 aa, Brucella spp.
VPGFIVERQLGHFKLIHPEYE

SEQ ID NO: 27155 - protein, 17 aa, Brucella spp.
CLSLGYFAATSDSSRSK

SEQ ID NO: 27156 - protein, 24 aa, Brucella spp.
AGTKQYGLPLVGVYGDFPQYRSRE

SEQ ID NO: 27157 - protein, 19 aa, Brucella spp.
EMKAMVAYIKYVSAGTVVG

SEQ ID NO: 27158 - protein, 25 aa, Brucella spp.
GDAKSYEFPPLWGPDSFNDGAGMNR

SEQ ID NO: 27159 - protein, 17 aa, Brucella spp.
DIAAFFQSKPRPAKANL

SEQ ID NO: 27160 - protein, 18 aa, Brucella spp.
ALTFDDVLLQPGHSEVMP

SEQ ID NO: 27161 - protein, 28 aa, Brucella spp.
RTRIAKDIELNLPLLSAAMDTVTESRLA

SEQ ID NO: 27162 - protein, 25 aa, Brucella spp.
DPKQKIYELMTRENLITVHENVNQD

SEQ ID NO: 27163 - protein, 24 aa, Brucella spp.
DEAKRLLHSHRIEKLLVVDDKDRC

SEQ ID NO: 27164 - protein, 17 aa, Brucella spp.
PGEVYLHQGRSFKAYRG

SEQ ID NO: 27165 - protein, 17 aa, Brucella spp.
EVYLHQGRSFKAYRGMG

SEQ ID NO: 27166 - protein, 17 aa, Brucella spp.
YLHQGRSFKAYRGMGSV

SEQ ID NO: 27167 - protein, 39 aa, Brucella spp.
TSGSPLRAWLPLLITPLGFMFCSWVALVWFPNSGGSGIP

SEQ ID NO: 27168 - protein, 26 aa, Brucella spp.
EGATLPPFYFVEKFTVGLLSMISGIP

SEQ ID NO: 27169 - protein, 28 aa, Brucella spp.
RETDLLDPINFVQKVQAILLSGGSAYGL

SEQ ID NO: 27170 - protein, 30 aa, Brucella spp.
FEIGKGVVPIVPAAILMDLGVGDFSVRPDE

SEQ ID NO: 27171 - protein, 25 aa, Brucella spp.
RTINPVHTMWDGDTIFALSTGKAKD

SEQ ID NO: 27172 - protein, 23 aa, Brucella spp.
QAESLPHLNLPAHRDYMIAESTR

SEQ ID NO: 27173 - protein, 17 aa, Brucella spp.
LNGLPAYAYTMAFVQML

SEQ ID NO: 27174 - protein, 25 aa, Brucella spp.
LPAYAYTMAFVQMLAAKGQLQKGDK

SEQ ID NO: 27175 - protein, 28 aa, Brucella spp.
HSSVARDLLMYLLTTLGVEPVALGRSDI

SEQ ID NO: 27176 - protein, 21 aa, Brucella spp.
LPTRDALLPILACLATVHEKK

SEQ ID NO: 27177 - protein, 17 aa, Brucella spp.
DGVKLFFQSGNAVHYRA

SEQ ID NO: 27178 - protein, 20 aa, Brucella spp.
ESFKPTVVGWVVGFNKKGKE

SEQ ID NO: 27179 - protein, 28 aa, Brucella spp.
TYGLTSVFYYIFAAVFFLIPVSIVAAEL

SEQ ID NO: 27180 - protein, 25 aa, Brucella spp.
RWGFLAIFLVWVESTIWFPTVLTFG

SEQ ID NO: 27181 - protein, 28 aa, Brucella spp.
QLTVTLYLIMYLLMFAAAIHLRYSEPNT

SEQ ID NO: 27182 - protein, 24 aa, Brucella spp.
GSPSAYIWMLIAGNVIFVAIPLIT

SEQ ID NO: 27183 - protein, 31 aa, Brucella spp.
VSGALWGTLIGFIFFMPLVGTALGAATGAIG

SEQ ID NO: 27184 - protein, 24 aa, Brucella spp.
KVPPALIVDHFVWAYCPSVAADKS

SEQ ID NO: 27185 - protein, 24 aa, Brucella spp.
SADELDVLVTLPLTQNLLDQIDSA

SEQ ID NO: 27186 - protein, 25 aa, Brucella spp.
KSGQALNWKTSIVDLIKALGLDSSL

SEQ ID NO: 27187 - protein, 26 aa, Brucella spp.
NDSATMNVWLHKQVIQKLKDSGGKLP

SEQ ID NO: 27188 - protein, 25 aa, Brucella spp.
ALIRDKRLETLYLLPASQTRDKDTL

SEQ ID NO: 27189 - protein, 28 aa, Brucella spp.
MLKVEDVLEILSIPLLGIIPESQDVLRA

SEQ ID NO: 27190 - protein, 36 aa, Brucella spp.
KKIASVFLESFLFYSGFYLPMYWSSRAKLTNTADLI

SEQ ID NO: 27191 - protein, 25 aa, Brucella spp.
RQAARQYFLQHVNQNTVFFHNLREK

SEQ ID NO: 27192 - protein, 25 aa, Brucella spp.
HVNQNTVFFHNLREKLDYLVAEGYY

SEQ ID NO: 27193 - protein, 30 aa, Brucella spp.
DEAYARKFRFPTFLGAFKYYTSYTLKTFDG

SEQ ID NO: 27194 - protein, 18 aa, Brucella spp.
NNEDMYLFSPYDVQRVYG

SEQ ID NO: 27195 - protein, 18 aa, Brucella spp.
YLFSPYDVQRVYGVPLTE

SEQ ID NO: 27196 - protein, 20 aa, Brucella spp.
EFFQVLAEIQFESGYPYIMF

SEQ ID NO: 27197 - protein, 20 aa, Brucella spp.
SGYPYIMFEDTVNRANPIDG

SEQ ID NO: 27198 - protein, 18 aa, Brucella spp.
IMFEDTVNRANPIDGRIT

SEQ ID NO: 27199 - protein, 27 aa, Brucella spp.
EEGVDFTNIYFYTVAYHAVRASNRIAV

SEQ ID NO: 27200 - protein, 30 aa, Brucella spp.
YAWKKGIKTIYYIRLRQMALEGTQVQGCVS

SEQ ID NO: 27201 - protein, 25 aa, Brucella spp.
GQFENTFMMYLPRLCEHCLNPTCVA

SEQ ID NO: 27202 - protein, 44 aa, Brucella spp.
SPVYKMAMDWKIAFPLHPEYRTLPMVWYVPPFSPLQSAAQAGKL

SEQ ID NO: 27203 - protein, 19 aa, Brucella spp.
SLLLFYPSPELQAGRAELK

SEQ ID NO: 27204 - protein, 26 aa, Brucella spp.
AKELPDYLPLFLEFLSTRSTEEIHDL

SEQ ID NO: 27205 - protein, 26 aa, Brucella spp.
RPSDTLIIILLWVQLLLGLSSIPVSL

SEQ ID NO: 27206 - protein, 34 aa, Brucella spp.
ASIVFKMHIFLGLTIFILFPFTRLVHMLSAPVRY

SEQ ID NO: 27207 - protein, 24 aa, Brucella spp.
KERRKLVLIARETPLHLVHLRNMC

SEQ ID NO: 27208 - protein, 26 aa, Brucella spp.
VTEMGAIVMPPVPAFYLQPQTVEDVA

SEQ ID NO: 27209 - protein, 36 aa, Brucella spp.
NLDTLPIQWCWPGEPAPLITWPLVITRAPDDPSDVN

SEQ ID NO: 27210 - protein, 18 aa, Brucella spp.
IADLWLPPAACSYRAMVV

SEQ ID NO: 27211 - protein, 32 aa, Brucella spp.
PGQARRVMMGLWSMLPQFSYTKLIIAVDPDID

SEQ ID NO: 27212 - protein, 21 aa, Brucella spp.
DVHNWDDVMWALATRFDASRD

SEQ ID NO: 27213 - protein, 27 aa, Brucella spp.
AAPARLVPPFLLNPLVSRVFHQVIRAH

SEQ ID NO: 27214 - protein, 27 aa, Brucella spp.
HVNKRFGFRPSDLPFTFLVEPGKPRIS

SEQ ID NO: 27215 - protein, 17 aa, Brucella spp.
LPFTFLVEPGKPRISVF

SEQ ID NO: 27216 - protein, 31 aa, Brucella spp.
NRKAGYLFQQDALMPWKTVLENVAIGLEIAG

SEQ ID NO: 27217 - protein, 26 aa, Brucella spp.
VLIRNPKYLLMDEPFGPLDAQTRVIM

SEQ ID NO: 27218 - protein, 26 aa, Brucella spp.
LDAQTRVIMGDLLLDLWSQDKKAVMF

SEQ ID NO: 27219 - protein, 28 aa, Brucella spp.
GAIWAVMAMLLWILSLTIGLPLGGSYGA

SEQ ID NO: 27220 - protein, 27 aa, Brucella spp.
VAIESLFLPFLLFIAAREIIAGHHWRN

SEQ ID NO: 27221 - protein, 35 aa, Brucella spp.
EIMPNFFHTLLAASALLWMLAFGLFVVEYGPMLLR

SEQ ID NO: 27222 - protein, 25 aa, Brucella spp.
KFAAAGLFALLAAPALAENIEVHML

SEQ ID NO: 27223 - protein, 20 aa, Brucella spp.
TPHYAMSMVALIAVGDKPEN

SEQ ID NO: 27224 - protein, 18 aa, Brucella spp.
PFFFALLAGCSPAEKQEP

SEQ ID NO: 27225 - protein, 24 aa, Brucella spp.
GPKGQIILRPTNEPIWFSSARDTL

SEQ ID NO: 27226 - protein, 26 aa, Brucella spp.
VSLSSLTIFLIPLIALLISHDAIVGE

SEQ ID NO: 27227 - protein, 19 aa, Brucella spp.
MERGTMLLLLSYPLSRIQV

SEQ ID NO: 27228 - protein, 28 aa, Brucella spp.
GIAIGVWLFFVLIYDAALLVFDQGQTIG

SEQ ID NO: 27229 - protein, 28 aa, Brucella spp.
NGAGKTTMIKLMLGLIRPTKGAVRVLGE

SEQ ID NO: 27230 - protein, 23 aa, Brucella spp.
ARLRLGYLPEHVSFNMALTGAET

SEQ ID NO: 27231 - protein, 27 aa, Brucella spp.
PVETGNLLLRWHRLGPDLYETEAPAEG

SEQ ID NO: 27232 - protein, 24 aa, Brucella spp.
NSVGFAIMYTNRLKILNNVSEGDR

SEQ ID NO: 27233 - protein, 29 aa, Brucella spp.
YRPNDLIDRVLWTVPQAKILINSPAVDTI

SEQ ID NO: 27234 - protein, 24 aa, Brucella spp.
PAVDTIRWAQTQFPALLPGGVVDS

SEQ ID NO: 27235 - protein, 23 aa, Brucella spp.
VDSHPLMKPLLKPTAQLKESKHN

SEQ ID NO: 27236 - protein, 21 aa, Brucella spp.
ISILILVAIFFFQDSLVRHPR

SEQ ID NO: 27237 - protein, 36 aa, Brucella spp.
LVRHPRFFTWLRRGYLLFILVWLGFYNHAQLSVVNV

SEQ ID NO: 27238 - protein, 35 aa, Brucella spp.
SLITGFNWEFFLTSPLIFILWGATAAGLLFWGRGP

SEQ ID NO: 27239 - protein, 31 aa, Brucella spp.
GLHERLWPLKYIIFLGLFALSLYSMALAELF

SEQ ID NO: 27240 - protein, 25 aa, Brucella spp.
KFARDWPFVIYALTLLAVGLFVERF

SEQ ID NO: 27241 - protein, 26 aa, Brucella spp.
PSYRLIPSCFPPIGLFDTVATAADLE

SEQ ID NO: 27242 - protein, 23 aa, Brucella spp.
LVEERLYRLARTEWVFGRTNSSI

SEQ ID NO: 27243 - protein, 24 aa, Brucella spp.
METPKLLWLKEHKPETFAAAWQFF

SEQ ID NO: 27244 - protein, 28 aa, Brucella spp.
PETFAAAWQFFDLTDFLTWKSCGSLARS

SEQ ID NO: 27245 - protein, 26 aa, Brucella spp.
FVDGVWGPYFSAMVPGLWLNEGGQSA

SEQ ID NO: 27246 - protein, 17 aa, Brucella spp.
IDHLIHMHPFAAEAEKA

SEQ ID NO: 27247 - protein, 17 aa, Brucella spp.
HLIHMHPFAAEAEKAAA

SEQ ID NO: 27248 - protein, 24 aa, Brucella spp.
AGVVPVIWEPIYTASKHAVQAFVH

SEQ ID NO: 27249 - protein, 32 aa, Brucella spp.
DLGSLPVIIGLLIIWTVFQTLNPVFLSSNNLV

SEQ ID NO: 27250 - protein, 18 aa, Brucella spp.
GFLYALLYNRFSMPSFVS

SEQ ID NO: 27251 - protein, 27 aa, Brucella spp.
NQSRGVPWMFALFVALVIAMNYALTRT

SEQ ID NO: 27252 - protein, 29 aa, Brucella spp.
SRSGLVGLLLPLHDNRFFSAMAQIFEAHV

SEQ ID NO: 27253 - protein, 30 aa, Brucella spp.
GCYDYDPFASFLPFPVISILQDVEGMIAKA

SEQ ID NO: 27254 - protein, 27 aa, Brucella spp.
RVTEPELHLIMPKLIAPRSAITGPLDS

SEQ ID NO: 27255 - protein, 24 aa, Brucella spp.
KTGSVWHLPTDEQWAFAAGTRFAD

SEQ ID NO: 27256 - protein, 27 aa, Brucella spp.
NVRRVVNFYFKQHGWGLPLVPGPRFHG

SEQ ID NO: 27257 - protein, 25 aa, Brucella spp.
GTLIELLFLWLFYASHKQLGKNWSV

SEQ ID NO: 27258 - protein, 28 aa, Brucella spp.
YVRHPMYLSFWLWAIAQFFLLPNWIAGL

SEQ ID NO: 27259 - protein, 27 aa, Brucella spp.
APGQGLLLIAPFKPVLLFAVLERKGFE

SEQ ID NO: 27260 - protein, 26 aa, Brucella spp.
SAGEVLFALLHREPLFLFPELENRGH

SEQ ID NO: 27261 - protein, 27 aa, Brucella spp.
GNECALFEMAWQRKLPLLLKGPTGCGK

SEQ ID NO: 27262 - protein, 25 aa, Brucella spp.
LDAPDSFMLVVSYNPGYQNLLKSLK

SEQ ID NO: 27263 - protein, 35 aa, Brucella spp.
TTVTNILLFGLWGLALFFLFAFYNPINLALDKLYW

SEQ ID NO: 27264 - protein, 27 aa, Brucella spp.
NLALDKLYWWYVIHLWVEGVWELIMAS

SEQ ID NO: 27265 - protein, 22 aa, Brucella spp.
EVAPFFTMVMFTFVMTWRAGRK

SEQ ID NO: 27266 - protein, 25 aa, Brucella spp.
EEDSLLLWVLVWSELITFAILLDAF

SEQ ID NO: 27267 - protein, 28 aa, Brucella spp.
EAAGSFFELYFLITGFHLLHVLFGSVIL

SEQ ID NO: 27268 - protein, 24 aa, Brucella spp.
VAAPAIICFSLILYRMGALQGAGT

SEQ ID NO: 27269 - protein, 22 aa, Brucella spp.
GSPQDYIKLADAIPRLLDETHE

SEQ ID NO: 27270 - protein, 24 aa, Brucella spp.
LEETVLFPDFHRQSGSYFAGVVIE

SEQ ID NO: 27271 - protein, 27 aa, Brucella spp.
LVVSLPLLFLASWLVYLAFFDRDVAFL

SEQ ID NO: 27272 - protein, 27 aa, Brucella spp.
NAAGLIVALWFYPRIRLRFKPGLYMRR

SEQ ID NO: 27273 - protein, 43 aa, Brucella spp.
TGGSKPLLGTNPFAFGWPRRDNPPYVFDFATSVAARGEIELHR

SEQ ID NO: 27274 - protein, 24 aa, Brucella spp.
GSAISTMIELLAGIMIGDRTSPEV

SEQ ID NO: 27275 - protein, 24 aa, Brucella spp.
LSPVHGEIIIAFSPEAFAAGRPGD

SEQ ID NO: 27276 - protein, 17 aa, Brucella spp.
YFKAILSAAPDLPAVIY

SEQ ID NO: 27277 - protein, 32 aa, Brucella spp.
YNSPYYGFATRADLFFALRAEHPNLVGFKEFG

SEQ ID NO: 27278 - protein, 27 aa, Brucella spp.
FDEGPDLVLYFKHMMVLKGDKEYTLHF

SEQ ID NO: 27279 - protein, 28 aa, Brucella spp.
GYVETQFRLFNTWYAEWSKLPGAVQRCK

SEQ ID NO: 27280 - protein, 26 aa, Brucella spp.
CLILLLLFIGFTAFAIPRILVNRKVH

SEQ ID NO: 27281 - protein, 23 aa, Brucella spp.
GLSRDGFLLLIDLDDFKPVNDTY

SEQ ID NO: 27282 - protein, 26 aa, Brucella spp.
PTMRTRWSAIFYAAADFDIAPLRRAL

SEQ ID NO: 27283 - protein, 24 aa, Brucella spp.
KPDSDLMRLNRAPVGVWVEVPARL

SEQ ID NO: 27284 - protein, 26 aa, Brucella spp.
WVEVPARLMEVLRLAIEIGRATGGAF

SEQ ID NO: 27285 - protein, 27 aa, Brucella spp.
AQSLGLDVLFLLRDGETIRPQPVGALF

SEQ ID NO: 27286 - protein, 27 aa, Brucella spp.
RAPEPGYDFIIQGIGGLMSITGERDDK

SEQ ID NO: 27287 - protein, 20 aa, Brucella spp.
NIVPYQVFRASDRDFIIACG

SEQ ID NO: 27288 - protein, 30 aa, Brucella spp.
RNSDRVIHRDEIIGILAAHFLTGTADEWIG

SEQ ID NO: 27289 - protein, 26 aa, Brucella spp.
QVKARNMLVQIPHPLNKDFVTVGSPF

SEQ ID NO: 27290 - protein, 27 aa, Brucella spp.
GTIVEVRDLFYATPARLKFMKTDRAEA

SEQ ID NO: 27291 - protein, 30 aa, Brucella spp.
TDVVKRIGIAFPHIRFSLAGTDRTPFEMPA

SEQ ID NO: 27292 - protein, 30 aa, Brucella spp.
VIARDRHPVAVLFLTLDPALVDVNVHPAKA

SEQ ID NO: 27293 - protein, 17 aa, Brucella spp.
RFRDPGLVRGLIVGAIK

SEQ ID NO: 27294 - protein, 30 aa, Brucella spp.
ALHARPIAGQMLLIPEIVDLPEEDAQRLAG

SEQ ID NO: 27295 - protein, 25 aa, Brucella spp.
WWDEPDWRALALAPAAWIYGRVSGR

SEQ ID NO: 27296 - protein, 20 aa, Brucella spp.
RRLIRAVPPRVSLPVLCVGN

SEQ ID NO: 27297 - protein, 21 aa, Brucella spp.
SLGCDFIIMDDGFQSARLHAD

SEQ ID NO: 27298 - protein, 22 aa, Brucella spp.
ILSAYRFLGSAAYPFVGSYIAY

SEQ ID NO: 27299 - protein, 31 aa, Brucella spp.
AEVHQMLKMRYPRLITIIVPRHPDRAPAIEA

SEQ ID NO: 27300 - protein, 25 aa, Brucella spp.
MLAGAINFLFNNPQHLRAMINAGVT

SEQ ID NO: 27301 - protein, 25 aa, Brucella spp.
TLAALEPFIQPLVLQAQLPGNRNEP

SEQ ID NO: 27302 - protein, 36 aa, Brucella spp.
ADGEEFLHFSELGVVFLLFIIGLELNPSRLWSLRHS

SEQ ID NO: 27303 - protein, 26 aa, Brucella spp.
GQRAFAILLFQDLAIVPILAIIPALS

SEQ ID NO: 27304 - protein, 29 aa, Brucella spp.
LEADIEPFRGIFLGLFFVAVGLSLNLSVI

SEQ ID NO: 27305 - protein, 43 aa, Brucella spp.
NLSVILEYWAVILAAVPIFMATKIVIIYLLCRIFRSSHNDAVR

SEQ ID NO: 27306 - protein, 17 aa, Brucella spp.
EVVRRMWQTRPAHWAEL

SEQ ID NO: 27307 - protein, 17 aa, Brucella spp.
MWQTRPAHWAELFKGGL

SEQ ID NO: 27308 - protein, 18 aa, Brucella spp.
NIEKVLDVFLPDSFPSNV

SEQ ID NO: 27309 - protein, 31 aa, Brucella spp.
ILVDGGLFNPVPFDLLFDKADIVIGIDVVGG

SEQ ID NO: 27310 - protein, 20 aa, Brucella spp.
RYRPPHIFVRPNVERIGLLD

SEQ ID NO: 27311 - protein, 23 aa, Brucella spp.
NVERIGLLDFLKFEQVISQSAAV

SEQ ID NO: 27312 - protein, 24 aa, Brucella spp.
GSERLIDCDLYVTLEPCAMCAAAI

SEQ ID NO: 27313 - protein, 25 aa, Brucella spp.
AAISFARIRRLYYGASDPKGGGIEH

SEQ ID NO: 27314 - protein, 29 aa, Brucella spp.
KERIDYKPRPDLVRPAPGDKGYLPAPQQS

SEQ ID NO: 27315 - protein, 32 aa, Brucella spp.
QGSATTRRYLSEPPLAYRQPASTAAVGELGPD

SEQ ID NO: 27316 - protein, 17 aa, Brucella spp.
REPLFVQRWEEMNLYKK

SEQ ID NO: 27317 - protein, 25 aa, Brucella spp.
HDIESDMIWVKFPVAGEVATENDLS

SEQ ID NO: 27318 - protein, 24 aa, Brucella spp.
LSGSAVVIWTTTPWTIPGNRAVSY

SEQ ID NO: 27319 - protein, 33 aa, Brucella spp.
SWRSKKPVIFRNTPQWFVYMDKNLGDGTTLRSR

SEQ ID NO: 27320 - protein, 27 aa, Brucella spp.
KESGADILRLWVMTTDYWEDQRLGKSI

SEQ ID NO: 27321 - protein, 24 aa, Brucella spp.
YRKLRNTIRWMLGTLAHDEGENVA

SEQ ID NO: 27322 - protein, 24 aa, Brucella spp.
PELERLMLHRLTELDELVRSGYDT

SEQ ID NO: 27323 - protein, 25 aa, Brucella spp.
ARALVDFMNVELSAFYFDIRKDALY

SEQ ID NO: 27324 - protein, 36 aa, Brucella spp.
AALQTVREIFVRLTTWLAPMLPFTMEEAWLDRYPQS

SEQ ID NO: 27325 - protein, 24 aa, Brucella spp.
AAEKAEILRLMGFDAVMEQPFTAE

SEQ ID NO: 27326 - protein, 24 aa, Brucella spp.
HGIYAVRFRLDDAMLYDGVASFGR

SEQ ID NO: 27327 - protein, 28 aa, Brucella spp.
DEGAPLLETFLFDFSGDLYGKTAAVSFF

SEQ ID NO: 27328 - protein, 17 aa, Brucella spp.
VSFFGFLRGEVKFDGLD

SEQ ID NO: 27329 - protein, 25 aa, Brucella spp.
ARAKGVTIILVTNSPRPHPGVVAQM

SEQ ID NO: 27330 - protein, 36 aa, Brucella spp.
EDYRELLQRLRSRNLPFICANPDIMVERGPRLIWCA

SEQ ID NO: 27331 - protein, 28 aa, Brucella spp.
DIMVERGPRLIWCAGALAREYGQLGGRT

SEQ ID NO: 27332 - protein, 25 aa, Brucella spp.
IGGERMPLPLVHALGVVKRAAAETN

SEQ ID NO: 27333 - protein, 25 aa, Brucella spp.
EGKLDDHFPLVVWQTGSGTQSNMNA

SEQ ID NO: 27334 - protein, 33 aa, Brucella spp.
AASQGHFELNVFKPVIAYNVLQSIRLLSDTMVS

SEQ ID NO: 27335 - protein, 26 aa, Brucella spp.
KELLERSLMLVTALAPAIGYDNAARI

SEQ ID NO: 27336 - protein, 25 aa, Brucella spp.
FALTSLTLLFFMSGFITCLNDILIP

SEQ ID NO: 27337 - protein, 26 aa, Brucella spp.
NYTQSMLIQFCFFGAYFIVSLPAGQL

SEQ ID NO: 27338 - protein, 28 aa, Brucella spp.
EADAVRFPYLLLALAFTVLAIIFAILKP

SEQ ID NO: 27339 - protein, 20 aa, Brucella spp.
AFVAIILLFITVATTGHIAM

SEQ ID NO: 27340 - protein, 20 aa, Brucella spp.
LFNSIMFPTIFSLALHGLGS

SEQ ID NO: 27341 - protein, 17 aa, Brucella spp.
MFPTIFSLALHGLGSHT

SEQ ID NO: 27342 - protein, 26 aa, Brucella spp.
VEGEDDLDILFLSASEIARKLGYGSV

SEQ ID NO: 27343 - protein, 31 aa, Brucella spp.
HGRRLRIATKYWRLTQQFFSQKHGIQVYRIV

SEQ ID NO: 27344 - protein, 25 aa, Brucella spp.
REAELVEIPLIQPADPFLDMAGEDL

SEQ ID NO: 27345 - protein, 25 aa, Brucella spp.
ENGDSLCLRPEFTIPVCRNHIALNA

SEQ ID NO: 27346 - protein, 27 aa, Brucella spp.
FPAAALDLLRQFLAIRVSLDTAAVTLR

SEQ ID NO: 27347 - protein, 28 aa, Brucella spp.
AEKMMATIREVYDLYGFEPVETPLVEYT

SEQ ID NO: 27348 - protein, 24 aa, Brucella spp.
PVETPLVEYTDALGKFLPDQDRPN

SEQ ID NO: 27349 - protein, 28 aa, Brucella spp.
QDDDEQWLSLRYDLTAPLARYVAENFET

SEQ ID NO: 27350 - protein, 25 aa, Brucella spp.
KPGPGRFRQFMQFDADTVGAPNVSA

SEQ ID NO: 27351 - protein, 23 aa, Brucella spp.
SADAEMCMMMADTLERLGIQRGD

SEQ ID NO: 27352 - protein, 20 aa, Brucella spp.
LADMQALFFAGGYEGRVKID

SEQ ID NO: 27353 - protein, 23 aa, Brucella spp.
SFPTYLLRRFPGRWPPHYPSRQL

SEQ ID NO: 27354 - protein, 23 aa, Brucella spp.
FAARRFFPCRKFGYFKLVKNNWV

SEQ ID NO: 27355 - protein, 29 aa, Brucella spp.
GTDYVDLYLIHWPMPSKDLFMETWRAFIK

SEQ ID NO: 27356 - protein, 20 aa, Brucella spp.
SKDLFMETWRAFIKLKEEGR

SEQ ID NO: 27357 - protein, 25 aa, Brucella spp.
KSVAQIILRWHIETGNIVIPKSITP

SEQ ID NO: 27358 - protein, 43 aa, Brucella spp.
EKTYKRPFMNRLLRSVLAQVLPYPARFRLALKLAKLGKPFASL

SEQ ID NO: 27359 - protein, 17 aa, Brucella spp.
KDYGYMLRLDPAYKDKA

SEQ ID NO: 27360 - protein, 24 aa, Brucella spp.
GSDLPIVHTVELIDWAYGGPTPQA

SEQ ID NO: 27361 - protein, 24 aa, Brucella spp.
LTAHRQLPLVVVLPETVEQVAQVL

SEQ ID NO: 27362 - protein, 27 aa, Brucella spp.
PLEDAVLLVMSRFNRILEIDYPNRVAV

SEQ ID NO: 27363 - protein, 23 aa, Brucella spp.
NNVLGIEMVLITGEVMRLGGKHL

SEQ ID NO: 27364 - protein, 22 aa, Brucella spp.
DFVRVGYPLDVEALLIVELDGP

SEQ ID NO: 27365 - protein, 24 aa, Brucella spp.
SEEQRLAFWAGRKAAFPAVGRISP

SEQ ID NO: 27366 - protein, 23 aa, Brucella spp.
DGNLHPLILYDANNPGELEAAED

SEQ ID NO: 27367 - protein, 22 aa, Brucella spp.
FGADILRLCVKVGGVLTGEHGV

SEQ ID NO: 27368 - protein, 28 aa, Brucella spp.
GEAAHNIVLLHTLRSCYQLLKDGVFYNR

SEQ ID NO: 27369 - protein, 20 aa, Brucella spp.
VFYNRSVIYNHPGVADVFLS

SEQ ID NO: 27370 - protein, 18 aa, Brucella spp.
VIYNHPGVADVFLSQHRA

SEQ ID NO: 27371 - protein, 21 aa, Brucella spp.
LTVLMVSAIVFMAVGIFTVDA

SEQ ID NO: 27372 - protein, 24 aa, Brucella spp.
NKNSGIVWDEEIFRKYIKKPREVI

SEQ ID NO: 27373 - protein, 24 aa, Brucella spp.
DAVAPLLIHLCLTQPAALTSRLGP

SEQ ID NO: 27374 - protein, 32 aa, Brucella spp.
HPARGGFLPPVPLPRRMWAGGAFTFRDDIRVG

SEQ ID NO: 27375 - protein, 34 aa, Brucella spp.
VPHGPHCRFITPSAPLLFRYSALTFNGHRIHYDA

SEQ ID NO: 27376 - protein, 17 aa, Brucella spp.
RGKPPVRFDFRSLSPLF

SEQ ID NO: 27377 - protein, 25 aa, Brucella spp.
SNTNALAEFLPVALSSFLMDNPGVN

SEQ ID NO: 27378 - protein, 26 aa, Brucella spp.
ASLETFPFREDYLVVVVPQGHPFARR

SEQ ID NO: 27379 - protein, 29 aa, Brucella spp.
ASAAKRLRRIMAIRIIALDDAWALRRLTI

SEQ ID NO: 27380 - protein, 19 aa, Brucella spp.
MNIMALISILHLSSGGVAL

SEQ ID NO: 27381 - protein, 23 aa, Brucella spp.
ERESRLFLQQGLFNLKKSDTKTL

SEQ ID NO: 27382 - protein, 29 aa, Brucella spp.
WLQKNNCQQFFFKYCSTFDSTPKGNIGPV

SEQ ID NO: 27383 - protein, 23 aa, Brucella spp.
GEEFTVICPALPVNGRTIYNGYL

SEQ ID NO: 27384 - protein, 29 aa, Brucella spp.
PVNGRTIYNGYLFVNGVLLSETGMRNHPV

SEQ ID NO: 27385 - protein, 18 aa, Brucella spp.
IDVLAEWVLAQSGDALPP

SEQ ID NO: 27386 - protein, 24 aa, Brucella spp.
GDALPPLVYATMPPEALKAVQERF

SEQ ID NO: 27387 - protein, 24 aa, Brucella spp.
STMFNEVPFLERFRLAAEAGFGGV

SEQ ID NO: 27388 - protein, 26 aa, Brucella spp.
AGFGGVEFLFPYDFDADVIARELKQH

SEQ ID NO: 27389 - protein, 24 aa, Brucella spp.
NMPGYFIVHQLEAVGLVKRVNRPN

SEQ ID NO: 27390 - protein, 24 aa, Brucella spp.
GELNYPYLFSVLESVGYRGWVGCE

SEQ ID NO: 27391 - protein, 23 aa, Brucella spp.
QLAAQMIRPGTVIYLDAGTTTLE

SEQ ID NO: 27392 - protein, 17 aa, Brucella spp.
QDLTVVTNDFVIAAFLS

SEQ ID NO: 27393 - protein, 20 aa, Brucella spp.
LTVVTNDFVIAAFLSQESNC

SEQ ID NO: 27394 - protein, 29 aa, Brucella spp.
SAAGEAIRRFNFDLAFISTSSFGARGVST

SEQ ID NO: 27395 - protein, 24 aa, Brucella spp.
WGLFLLLFVRLLAMIWVPLTDPTE

SEQ ID NO: 27396 - protein, 23 aa, Brucella spp.
GSRRWGWLFFLGLAIGLLAKGPV

SEQ ID NO: 27397 - protein, 28 aa, Brucella spp.
EHARGSIWLFWIVATLPWSPLLPVLIWR

SEQ ID NO: 27398 - protein, 27 aa, Brucella spp.
DGKGLHLYLLLFALTPLVFFTPAANIL

SEQ ID NO: 27399 - protein, 23 aa, Brucella spp.
VVEVLLIFLVITIGSFFGLGRSF

SEQ ID NO: 27400 - protein, 30 aa, Brucella spp.
LPGGGPIWPLGELIRPLLGAPFLGAITASL

SEQ ID NO: 27401 - protein, 26 aa, Brucella spp.
RAGGAKVLLILALAARARAIFVRAGL

SEQ ID NO: 27402 - protein, 17 aa, Brucella spp.
FHTLVVIEKWEPRPDNQ

SEQ ID NO: 27403 - protein, 26 aa, Brucella spp.
LSKGDRYLMIAVIALAAASALLPIVT

SEQ ID NO: 27404 - protein, 26 aa, Brucella spp.
AAASALLPIVTYLQRVDFNPANKAER

SEQ ID NO: 27405 - protein, 30 aa, Brucella spp.
HVSVLIQPWEFIIILGAALGTFFVANPFSL

SEQ ID NO: 27406 - protein, 28 aa, Brucella spp.
SASKPNLDLIMGIPVDVQVVLGGTTMPV

SEQ ID NO: 27407 - protein, 17 aa, Brucella spp.
IKAKLFTFEDIERLSQR

SEQ ID NO: 27408 - protein, 19 aa, Brucella spp.
LFTFEDIERLSQRARLLLF

SEQ ID NO: 27409 - protein, 26 aa, Brucella spp.
RLSQRARLLLFDEVQTEQIATALREA

SEQ ID NO: 27410 - protein, 23 aa, Brucella spp.
AEARRIIARIAIDLSERGIITLD

SEQ ID NO: 27411 - protein, 27 aa, Brucella spp.
VGAALVPVFIIIPLAGIAASAFQNAPR

SEQ ID NO: 27412 - protein, 29 aa, Brucella spp.
KLLAASVIVFLVFFKGNSLFTDAVATDPG

SEQ ID NO: 27413 - protein, 25 aa, Brucella spp.
VNSADLTVLMTLPATWVARYSSKNY

SEQ ID NO: 27414 - protein, 28 aa, Brucella spp.
DEDRTQFLARMRPRLLSLAGIIHGTVCG

SEQ ID NO: 27415 - protein, 23 aa, Brucella spp.
ILSIARWTVVTYLQNAKIKLNCS

SEQ ID NO: 27416 - protein, 27 aa, Brucella spp.
LSHAFSWHWLFLVNVGPGILVTIAAWN

SEQ ID NO: 27417 - protein, 24 aa, Brucella spp.
SLLDKFDWWGLFGMAAFLGSLEYV

SEQ ID NO: 27418 - protein, 23 aa, Brucella spp.
HTIFIMSIILTVGAIVFFYRVFT

SEQ ID NO: 27419 - protein, 25 aa, Brucella spp.
LTVGAIVFFYRVFTAEQPIVDFRAF

SEQ ID NO: 27420 - protein, 25 aa, Brucella spp.
VGLYGLTYLYPLYLSMIRGYDALMI

SEQ ID NO: 27421 - protein, 25 aa, Brucella spp.
RMDPRLMMMIGFVGFAIGTWLVTGL

SEQ ID NO: 27422 - protein, 29 aa, Brucella spp.
QQATLLSFIDVFFILTMMFCSLAICAMLL

SEQ ID NO: 27423 - protein, 30 aa, Brucella spp.
LAANIRKPRPIIFLIKAGAPVDTETTRLKA

SEQ ID NO: 27424 - protein, 24 aa, Brucella spp.
QAYERIAPILLAVAAKYQGEPCCA

SEQ ID NO: 27425 - protein, 18 aa, Brucella spp.
IAEIYGILRDGLGLSAPA

SEQ ID NO: 27426 - protein, 32 aa, Brucella spp.
REHGWNIPLATTARIWRAGCIIRSQLLDDIAQ

SEQ ID NO: 27427 - protein, 24 aa, Brucella spp.
GNESRNLLMAPAFVPRMETSVKSL

SEQ ID NO: 27428 - protein, 26 aa, Brucella spp.
GIIRPGWLVMLVFLFASIFASSDPAT

SEQ ID NO: 27429 - protein, 23 aa, Brucella spp.
ALVPFAMLLVVLPGLMGLRKLTA

SEQ ID NO: 27430 - protein, 28 aa, Brucella spp.
ENMLLADFFLMIVLFGTLNAMMESFFFR

SEQ ID NO: 27431 - protein, 32 aa, Brucella spp.
AMMESFFFRRMDPVWLTLILAIFGLGMTAKVV

SEQ ID NO: 27432 - protein, 39 aa, Brucella spp.
ERDLLPSWLHAFWDPTHLWRRRIWLSLKTKPLRGWHVQQ

SEQ ID NO: 27433 - protein, 28 aa, Brucella spp.
GFEKALPYSRIFYAVKANPAPEILRLLA

SEQ ID NO: 27434 - protein, 24 aa, Brucella spp.
ANPAPEILRLLASLGSSFDTASVA

SEQ ID NO: 27435 - protein, 24 aa, Brucella spp.
LADEGIILRMVNMGGGFPTRYLKD

SEQ ID NO: 27436 - protein, 26 aa, Brucella spp.
ADNDNVRWVYLDIGKFGGLAETMDEA

SEQ ID NO: 27437 - protein, 24 aa, Brucella spp.
LYEKTPYPLPVSLTIGDEILIEGT

SEQ ID NO: 27438 - protein, 26 aa, Brucella spp.
VQQLAHVWRFDDVFSSTVLMEFDKKG

SEQ ID NO: 27439 - protein, 26 aa, Brucella spp.
AFTDNRLLIVFTSKPEKPLKLAPGHK

SEQ ID NO: 27440 - protein, 23 aa, Brucella spp.
DLQKIFVLRRILAPMGTTDAIEF

SEQ ID NO: 27441 - protein, 22 aa, Brucella spp.
IDRGLTLFFPAPHSFTGEDCAE

SEQ ID NO: 27442 - protein, 22 aa, Brucella spp.
NLDRLIAIWPELASIDPVTREA

SEQ ID NO: 27443 - protein, 21 aa, Brucella spp.
DVPNLFIVPSTLDLLGIEMEI

SEQ ID NO: 27444 - protein, 24 aa, Brucella spp.
FEGEDWLYFPAIAPQVAIIRATTA

SEQ ID NO: 27445 - protein, 22 aa, Brucella spp.
GDRIILHWVRSNWKEHLMLVEK

SEQ ID NO: 27446 - protein, 23 aa, Brucella spp.
LSALRQFFRFLYSEGFRQDDPTG

SEQ ID NO: 27447 - protein, 20 aa, Brucella spp.
LIDRPDFFAWLEANWQEVFS

SEQ ID NO: 27448 - protein, 18 aa, Brucella spp.
DFFAWLEANWQEVFSGGA

SEQ ID NO: 27449 - protein, 17 aa, Brucella spp.
AGETHFRIRIVAEAFTG

SEQ ID NO: 27450 - protein, 17 aa, Brucella spp.
QGTIARLFPSIPELFSV

SEQ ID NO: 27451 - protein, 19 aa, Brucella spp.
TIARLFPSIPELFSVDANV

SEQ ID NO: 27452 - protein, 18 aa, Brucella spp.
GDRNYIINSHIILGNATI

SEQ ID NO: 27453 - protein, 25 aa, Brucella spp.
TTPNQYNLFFGGQPGFNIWDGGNSA

SEQ ID NO: 27454 - protein, 20 aa, Brucella spp.
SLMRLLFMALKPTRGLINIF

SEQ ID NO: 27455 - protein, 17 aa, Brucella spp.
VFGYGSLMWRPGFAHVE

SEQ ID NO: 27456 - protein, 18 aa, Brucella spp.
LAEEIVIWSTPQFNFVRL

SEQ ID NO: 27457 - protein, 17 aa, Brucella spp.
VIWSTPQFNFVRLSDAF

SEQ ID NO: 27458 - protein, 18 aa, Brucella spp.
HFFDWCHARWPEISAVRS

SEQ ID NO: 27459 - protein, 23 aa, Brucella spp.
QAAAFRFLNALQILKLAVSLGGT

SEQ ID NO: 27460 - protein, 25 aa, Brucella spp.
LNAFEPLIVYNILSSMRLLGRAMTN

SEQ ID NO: 27461 - protein, 17 aa, Brucella spp.
DGLKLFPILYKAFTEKD

SEQ ID NO: 27462 - protein, 18 aa, Brucella spp.
YLLRVEQLYPFPAKALIN

SEQ ID NO: 27463 - protein, 27 aa, Brucella spp.
VGGQIVVRPMMYLALSYDHRIVDGKEA

SEQ ID NO: 27464 - protein, 23 aa, Brucella spp.
VSGVEFLFKKNKITPYIGTGKIV

SEQ ID NO: 27465 - protein, 17 aa, Brucella spp.
IFIEAGFDWREPGCSMC

SEQ ID NO: 27466 - protein, 26 aa, Brucella spp.
LKNNAQFFIEYFALDLIMTDGVCTGV

SEQ ID NO: 27467 - protein, 17 aa, Brucella spp.
PERLLPYRTLPLFAVGE

SEQ ID NO: 27468 - protein, 25 aa, Brucella spp.
PNEAFELIWQFLSLADPIFERSCDG

SEQ ID NO: 27469 - protein, 27 aa, Brucella spp.
PEAIAFLEWLRDDHFIFLGLRELVFEG

SEQ ID NO: 27470 - protein, 20 aa, Brucella spp.
SKVDLLWFGGIGTYIRSSAE

SEQ ID NO: 27471 - protein, 17 aa, Brucella spp.
LWFGGIGTYIRSSAETD

SEQ ID NO: 27472 - protein, 23 aa, Brucella spp.
RMGPLYRWRFTGFTPDRILIAPS

SEQ ID NO: 27473 - protein, 25 aa, Brucella spp.
AVALKHLLHVAVAQIFYLDLPDHSA

SEQ ID NO: 27474 - protein, 23 aa, Brucella spp.
ITDGQIFLETNLFYQGIRPAVNV

SEQ ID NO: 27475 - protein, 24 aa, Brucella spp.
DQGQDVLFFVDNIFRFTQAGSEVS

SEQ ID NO: 27476 - protein, 18 aa, Brucella spp.
IERFLSQPFFVAEVFTGS

SEQ ID NO: 27477 - protein, 23 aa, Brucella spp.
VGVLGLEFFVLKDGTLLANEFAP

SEQ ID NO: 27478 - protein, 23 aa, Brucella spp.
LVDPAIMLMPLAGFDRLGHRLGY

SEQ ID NO: 27479 - protein, 20 aa, Brucella spp.
RRFHRLILTPCKMPRLLAAI

SEQ ID NO: 27480 - protein, 23 aa, Brucella spp.
DSLGLLFLLKDYLSTLESPPVLI

SEQ ID NO: 27481 - protein, 23 aa, Brucella spp.
RLATYAMWWIKASIQEYILRSWS

SEQ ID NO: 27482 - protein, 17 aa, Brucella spp.
VEPEKFWKGFAAIIRDL

SEQ ID NO: 27483 - protein, 23 aa, Brucella spp.
GAMGYKFQFITLAGFHQLNYGMF

SEQ ID NO: 27484 - protein, 17 aa, Brucella spp.
SGKRLLWPVEGTRLRVP

SEQ ID NO: 27485 - protein, 17 aa, Brucella spp.
LLWPVEGTRLRVPVELA

SEQ ID NO: 27486 - protein, 27 aa, Brucella spp.
REAKGGFIPLFMTIGKLPHTRGFCAVL

SEQ ID NO: 27487 - protein, 20 aa, Brucella spp.
QEQIDYLRFPLGHLPKAQVR

SEQ ID NO: 27488 - protein, 23 aa, Brucella spp.
RKERMFRLLIDMGFPEIEIGFPS

SEQ ID NO: 27489 - protein, 23 aa, Brucella spp.
EAQLDRFLMQIDILYPELAAERR

SEQ ID NO: 27490 - protein, 17 aa, Brucella spp.
AYIRPLFCRGIGPFRWA

SEQ ID NO: 27491 - protein, 24 aa, Brucella spp.
EDYLRILRFFRFFAWYGSGRPEAE

SEQ ID NO: 27492 - protein, 24 aa, Brucella spp.
RPWFKLFFWLFVINAIFLGWLGSR

SEQ ID NO: 27493 - protein, 23 aa, Brucella spp.
TGFRVIVFLVLFAGLVYIAKRSI

SEQ ID NO: 27494 - protein, 23 aa, Brucella spp.
AERDYWYPMLVVVDEAQLFAPAA

SEQ ID NO: 27495 - protein, 22 aa, Brucella spp.
KPEHYLFDLWTFITDRLTKAGV

SEQ ID NO: 27496 - protein, 25 aa, Brucella spp.
GEPPPTLFEYIPDNALVFIDESHVT

SEQ ID NO: 27497 - protein, 23 aa, Brucella spp.
FFHQLMVFFGIAGSLLVLNVSQT

SEQ ID NO: 27498 - protein, 24 aa, Brucella spp.
PQDSHYLFRRFINLIRERKGQAPL

SEQ ID NO: 27499 - protein, 24 aa, Brucella spp.
TEEQLELLWRISPEPILCFDGDGA

SEQ ID NO: 27500 - protein, 19 aa, Brucella spp.
SFQAIIIWRDQLNESNILL

SEQ ID NO: 27501 - protein, 23 aa, Brucella spp.
FSTYATWWIRQAITRSIADQART

SEQ ID NO: 27502 - protein, 17 aa, Brucella spp.
LLFNYPSTWNHLMADHA

SEQ ID NO: 27503 - protein, 23 aa, Brucella spp.
ETMTFVLLVFMLMQPLFGALSDK

SEQ ID NO: 27504 - protein, 23 aa, Brucella spp.
RARNRLWMAIACFAGIYGVMAGK

SEQ ID NO: 27505 - protein, 20 aa, Brucella spp.
KMVRPHVALITLIAPAHLGH

SEQ ID NO: 27506 - protein, 23 aa, Brucella spp.
LVINLSWFFIPFAAFVMVGAGNA

SEQ ID NO: 27507 - protein, 17 aa, Brucella spp.
YGIILCMIIMLLFAFIV

SEQ ID NO: 27508 - protein, 17 aa, Brucella spp.
CMIIMLLFAFIVVRGLS

SEQ ID NO: 27509 - protein, 23 aa, Brucella spp.
NVDTLIVIPNQNLFRIANDKTTF

SEQ ID NO: 27510 - protein, 23 aa, Brucella spp.
PESAYAYYIIGLSYFRQIPDVTR

SEQ ID NO: 27511 - protein, 17 aa, Brucella spp.
VFRQWGFPVNPLMKRFN

SEQ ID NO: 27512 - protein, 23 aa, Brucella spp.
ARREIALHRFLFGLGIRHVGEVN

SEQ ID NO: 27513 - protein, 17 aa, Brucella spp.
GGDIPMMGFETLTFCPI

SEQ ID NO: 27514 - protein, 17 aa, Brucella spp.
PMMGFETLTFCPIDRRL

SEQ ID NO: 27515 - protein, 22 aa, Brucella spp.
VVSAALWWSKPLAWILARREIR

SEQ ID NO: 27516 - protein, 23 aa, Brucella spp.
MDAELMPFLRGQLLIFDMRVERP

SEQ ID NO: 27517 - protein, 23 aa, Brucella spp.
HNAPIKIFILNNQYMGMVRQWQQ

SEQ ID NO: 27518 - protein, 17 aa, Brucella spp.
DQFISIMKPLGLVEICR

SEQ ID NO: 27519 - protein, 23 aa, Brucella spp.
AGRSPIFRLFGYAGTGKTTLARY

SEQ ID NO: 27520 - protein, 17 aa, Brucella spp.
WIVFPCLLLNYFGQAAF

SEQ ID NO: 27521 - protein, 22 aa, Brucella spp.
LGLALVMRLVLLASISWIVTLR

SEQ ID NO: 27522 - protein, 26 aa, Brucella spp.
AWPRAFRIFLILMGLLPILTALSGYI

SEQ ID NO: 27523 - protein, 23 aa, Brucella spp.
LATNLFMWAVIGLALGWFIQHYA

SEQ ID NO: 27524 - protein, 22 aa, Brucella spp.
HAKLIVVRIIGGETYWPYGLEA

SEQ ID NO: 27525 - protein, 21 aa, Brucella spp.
PFELLVPHILPGVRLLVLSND

SEQ ID NO: 27526 - protein, 18 aa, Brucella spp.
IATPDMMPLVGRLGKVLG

SEQ ID NO: 27527 - protein, 17 aa, Brucella spp.
MMPLVGRLGKVLGPRGM

SEQ ID NO: 27528 - protein, 22 aa, Brucella spp.
QVTMGYIYMLKLHHLVDDKIHA

SEQ ID NO: 27529 - protein, 23 aa, Brucella spp.
AAPVAHIWFLKSLPSRIGTLLDM

SEQ ID NO: 27530 - protein, 27 aa, Brucella spp.
ESGNRPEWMIMKIVPVIPPDLRPLVPL

SEQ ID NO: 27531 - protein, 18 aa, Brucella spp.
DILQRVVRWQLARRQQGS

SEQ ID NO: 27532 - protein, 18 aa, Brucella spp.
MYEFLDRLITIALPRVRD

SEQ ID NO: 27533 - protein, 22 aa, Brucella spp.
GQPLYMLFYAALMAFFCFFYTA

SEQ ID NO: 27534 - protein, 20 aa, Brucella spp.
GISDFDFFIQTDAAINPGNS

SEQ ID NO: 27535 - protein, 18 aa, Brucella spp.
DFFIQTDAAINPGNSGGA

SEQ ID NO: 27536 - protein, 25 aa, Brucella spp.
ISRSNCMVIFINQIRMKIGVMFGSP

SEQ ID NO: 27537 - protein, 26 aa, Brucella spp.
EEDGDRFIEIWNLVFMQFEQQTPELR

SEQ ID NO: 27538 - protein, 26 aa, Brucella spp.
LGAKEPLMWRLLPALIREMGQAYPEL

SEQ ID NO: 27539 - protein, 25 aa, Brucella spp.
GDEMTRIIWQFIKDKLIHPYLDIDL

SEQ ID NO: 27540 - protein, 26 aa, Brucella spp.
DFAGRLSFFFAIGMNFFMEIAKLRAA

SEQ ID NO: 27541 - protein, 24 aa, Brucella spp.
FRNRLDAIIPFGPLPVPVIHQVVQ

SEQ ID NO: 27542 - protein, 23 aa, Brucella spp.
GRMRKFYEEVVLLSQAFVINPDL

SEQ ID NO: 27543 - protein, 19 aa, Brucella spp.
LFGWAWLIVTGILLILDRG

SEQ ID NO: 27544 - protein, 24 aa, Brucella spp.
SLVCSLLFLRPLVAKLSGLALKAD

SEQ ID NO: 27545 - protein, 20 aa, Brucella spp.
AVYIHLTLMPYIPAAGELKT

SEQ ID NO: 27546 - protein, 21 aa, Brucella spp.
PIDFQEFMILPVGATSIREAV

SEQ ID NO: 27547 - protein, 17 aa, Brucella spp.
PIVEFMTFNFAMQAIDQ

SEQ ID NO: 27548 - protein, 17 aa, Brucella spp.
VEFMTFNFAMQAIDQIV

SEQ ID NO: 27549 - protein, 24 aa, Brucella spp.
KQTVPHFYLTIDCELDALLALRSQ

SEQ ID NO: 27550 - protein, 25 aa, Brucella spp.
EPDGKLIWTYFEAMVPQALPKSMLV

SEQ ID NO: 27551 - protein, 23 aa, Brucella spp.
DEAPQYVLIHDGVRPFIGQDLLE

SEQ ID NO: 27552 - protein, 23 aa, Brucella spp.
FREDLYYRLNVVPLRLPPLRERS

SEQ ID NO: 27553 - protein, 19 aa, Brucella spp.
VIINVALILFLILLICREV

SEQ ID NO: 27554 - protein, 26 aa, Brucella spp.
NDRAPRLVFLDIWLQGSRLDGLALLD

SEQ ID NO: 27555 - protein, 25 aa, Brucella spp.
KAEYQDLFLRENLPIDVIISPEIEV

SEQ ID NO: 27556 - protein, 19 aa, Brucella spp.
LSPFDLHLLDWIYQHGSDV

SEQ ID NO: 27557 - protein, 25 aa, Brucella spp.
LPLRDIVVFPHMIVPLFVGREKSIR

SEQ ID NO: 27558 - protein, 18 aa, Brucella spp.
VRNYLDWLLSIPWGKKSK

SEQ ID NO: 27559 - protein, 27 aa, Brucella spp.
TVTEIYDYMRLLFARVGIPYSPATGLP

SEQ ID NO: 27560 - protein, 17 aa, Brucella spp.
EQLTLLDMLRAFVAFRE

SEQ ID NO: 27561 - protein, 17 aa, Brucella spp.
LTLLDMLRAFVAFREEV

SEQ ID NO: 27562 - protein, 22 aa, Brucella spp.
VDLLMTNFHLPRSTLFMLVSAF

SEQ ID NO: 27563 - protein, 18 aa, Brucella spp.
AGHMPLWFAPVQVVVATI

SEQ ID NO: 27564 - protein, 24 aa, Brucella spp.
SAPRVWWMFRVMGVKNVYVLDGGF

SEQ ID NO: 27565 - protein, 24 aa, Brucella spp.
GLKKYFIFRFPQCPGALRSFLDLL

SEQ ID NO: 27566 - protein, 17 aa, Brucella spp.
HTARLWTIVLEISVMMA

SEQ ID NO: 27567 - protein, 18 aa, Brucella spp.
ARLWTIVLEISVMMAQFP

SEQ ID NO: 27568 - protein, 18 aa, Brucella spp.
PGEWLLDLPLLGKTYAQF

SEQ ID NO: 27569 - protein, 18 aa, Brucella spp.
WLLDLPLLGKTYAQFSAD

SEQ ID NO: 27570 - protein, 25 aa, Brucella spp.
TEHSSKLYWTTTAISVAWAAGGVAI

SEQ ID NO: 27571 - protein, 28 aa, Brucella spp.
VAGVALPIAMFWGFAQLVKRAQEMQNAA

SEQ ID NO: 27572 - protein, 23 aa, Brucella spp.
DRLNRFVFRSGLIMKPVFAAART

SEQ ID NO: 27573 - protein, 24 aa, Brucella spp.
RMQADLILFTELFISGYPPEDMVL

SEQ ID NO: 27574 - protein, 18 aa, Brucella spp.
IIVFDLDGTLVDTAPDLL

SEQ ID NO: 27575 - protein, 21 aa, Brucella spp.
RLDRWFKIHYPGLGFGHLQKL

SEQ ID NO: 27576 - protein, 17 aa, Brucella spp.
KGAFPFILHCFSSGRAL

SEQ ID NO: 27577 - protein, 17 aa, Brucella spp.
PFILHCFSSGRALAEKG

SEQ ID NO: 27578 - protein, 17 aa, Brucella spp.
RFHAVYWPAFLMSAQLP

SEQ ID NO: 27579 - protein, 25 aa, Brucella spp.
AAATPYVWDILIRNVYAFGCRGRGI

SEQ ID NO: 27580 - protein, 25 aa, Brucella spp.
LVTGFDILFFWVARMMMMGLHFMEE

SEQ ID NO: 27581 - protein, 19 aa, Brucella spp.
GIFLAFQYPMEIPGVATME

SEQ ID NO: 27582 - protein, 18 aa, Brucella spp.
VYDLFYMFQQRGFTTLRF

SEQ ID NO: 27583 - protein, 24 aa, Brucella spp.
HALLSICILLVLLGGVGFVILRGG

SEQ ID NO: 27584 - protein, 26 aa, Brucella spp.
GDGSPEMIFMLRIPKMPVADAKHLWP

SEQ ID NO: 27585 - protein, 25 aa, Brucella spp.
KRDYEYLMRLWENVRTLTLQSTAPA

SEQ ID NO: 27586 - protein, 23 aa, Brucella spp.
REAKDFMRMLMPSHAKVVQPYRD

SEQ ID NO: 27587 - protein, 19 aa, Brucella spp.
VRYVLKEFPILGPDSMRAH

SEQ ID NO: 27588 - protein, 24 aa, Brucella spp.
VFDRKNYFYPDLPQGYQISQFKQP

SEQ ID NO: 27589 - protein, 24 aa, Brucella spp.
EAHDYRYFPDPDLLPLEFDQAFVD

SEQ ID NO: 27590 - protein, 24 aa, Brucella spp.
DGKADFVFSLNYEVLPAIEVKDFS

SEQ ID NO: 27591 - protein, 23 aa, Brucella spp.
DAEFNNIWQQINFDLQQAGRTFE

SEQ ID NO: 27592 - protein, 25 aa, Brucella spp.
DGRGFPYFWLHFGRGKAPVADDSDI

SEQ ID NO: 27593 - protein, 24 aa, Brucella spp.
GGALVYFFFTPMVMWFFLAMQQTG

SEQ ID NO: 27594 - protein, 23 aa, Brucella spp.
EPHRLAFYLYDLASSFHSQWNRG

SEQ ID NO: 27595 - protein, 17 aa, Brucella spp.
SRSPFELFKFGFSAYKN

SEQ ID NO: 27596 - protein, 23 aa, Brucella spp.
TELRPTLFLAQLSNLLAGNISIV

SEQ ID NO: 27597 - protein, 23 aa, Brucella spp.
PETKFRIWFEIEAYACEALAELG

SEQ ID NO: 27598 - protein, 17 aa, Brucella spp.
AEAQAIFRKWGLDFAIV

SEQ ID NO: 27599 - protein, 17 aa, Brucella spp.
IFRKWGLDFAIVGKTTD

SEQ ID NO: 27600 - protein, 17 aa, Brucella spp.
QTMLLVFTSFSLLWMVL

SEQ ID NO: 27601 - protein, 17 aa, Brucella spp.
MLLVFTSFSLLWMVLSI

SEQ ID NO: 27602 - protein, 20 aa, Brucella spp.
RNVMFMILTLIVLVAALNII

SEQ ID NO: 27603 - protein, 23 aa, Brucella spp.
LDLFLFYVFFEASLIPMFIIIGV

SEQ ID NO: 27604 - protein, 23 aa, Brucella spp.
REGVMEFLLINHPLDCPICDQGG

SEQ ID NO: 27605 - protein, 22 aa, Brucella spp.
NWSLWFDLKILFLTPIRLLNTE

SEQ ID NO: 27606 - protein, 17 aa, Brucella spp.
VDRLIIFRSPLVIGAAD

SEQ ID NO: 27607 - protein, 24 aa, Brucella spp.
ETTDKLLFFTTGGKFFTIGANTLP

SEQ ID NO: 27608 - protein, 24 aa, Brucella spp.
IPPLLVIFFWYFGVLSVLPPVRQS

SEQ ID NO: 27609 - protein, 17 aa, Brucella spp.
LILPDVTFLPQTAQFRH

SEQ ID NO: 27610 - protein, 22 aa, Brucella spp.
DPSYILVMYLVPLVVFLVTGFI

SEQ ID NO: 27611 - protein, 19 aa, Brucella spp.
TMLFFFAIFIFHEPFSTAQ

SEQ ID NO: 27612 - protein, 24 aa, Brucella spp.
ANLVSLIPTLVLKPYWAERFELGI

SEQ ID NO: 27613 - protein, 18 aa, Brucella spp.
RIAMLVRWGFVPAWVKDP

SEQ ID NO: 27614 - protein, 22 aa, Brucella spp.
QNEVYVWPYFYAMPLDKLTPPQ

SEQ ID NO: 27615 - protein, 17 aa, Brucella spp.
DHDPLFLVEVTVKGFAP

SEQ ID NO: 27616 - protein, 17 aa, Brucella spp.
LFLVEVTVKGFAPEKGE

SEQ ID NO: 27617 - protein, 17 aa, Brucella spp.
IRRVQMWLGHQTLQMTM

SEQ ID NO: 27618 - protein, 18 aa, Brucella spp.
QMWLGHQTLQMTMRYAHL

SEQ ID NO: 27619 - protein, 17 aa, Brucella spp.
ASHFQNFVLFTNYQFYM

SEQ ID NO: 27620 - protein, 18 aa, Brucella spp.
HFQNFVLFTNYQFYMDEF

SEQ ID NO: 27621 - protein, 19 aa, Brucella spp.
ALGGLDMWTNQLFGFSFFG

SEQ ID NO: 27622 - protein, 20 aa, Brucella spp.
LDMWTNQLFGFSFFGTMKHG

SEQ ID NO: 27623 - protein, 17 aa, Brucella spp.
LYAMMFLFGSVVFPIYS

SEQ ID NO: 27624 - protein, 19 aa, Brucella spp.
EPILRRLVPTLIIIFLIIL

SEQ ID NO: 27625 - protein, 27 aa, Brucella spp.
RRLVPTLIIIFLIILGVARVFSLLAWR

SEQ ID NO: 27626 - protein, 25 aa, Brucella spp.
GIYLFPLFYPTLGFALLLFIRRPFL

SEQ ID NO: 27627 - protein, 17 aa, Brucella spp.
ALLLFIRRPFLIAVAFM

SEQ ID NO: 27628 - protein, 24 aa, Brucella spp.
AVVVRIWWKPLVTLIWYGALVMML

SEQ ID NO: 27629 - protein, 19 aa, Brucella spp.
EANRAFYRLTVLPLIGRTA

SEQ ID NO: 27630 - protein, 18 aa, Brucella spp.
AFYRLTVLPLIGRTAKAF

SEQ ID NO: 27631 - protein, 23 aa, Brucella spp.
LAARLLHFFFTSASVLAIAAGDF

SEQ ID NO: 27632 - protein, 23 aa, Brucella spp.
ECGSHWPFQQPVLVKLAQSGRQP

SEQ ID NO: 27633 - protein, 23 aa, Brucella spp.
ADVAFEFFSLLGAPYYCFHDADV

SEQ ID NO: 27634 - protein, 28 aa, Brucella spp.
FAELFEIMKGLPVTIRLLDPPLHEFLPH

SEQ ID NO: 27635 - protein, 22 aa, Brucella spp.
YSVYAFHWGFSDTGLFGIHAAT

SEQ ID NO: 27636 - protein, 18 aa, Brucella spp.
FKGRKVVLFAVPGAFTPT

SEQ ID NO: 27637 - protein, 18 aa, Brucella spp.
VVLFAVPGAFTPTCSLNH

SEQ ID NO: 27638 - protein, 24 aa, Brucella spp.
DSLVLFMIIFLWTPPHFWALSLFT

SEQ ID NO: 27639 - protein, 20 aa, Brucella spp.
ILYQHLFWFFGHPEVYILIQ

SEQ ID NO: 27640 - protein, 25 aa, Brucella spp.
ARSQIVVFMNFMLSLVVLVLLGASA

SEQ ID NO: 27641 - protein, 18 aa, Brucella spp.
FIRKYIFPGGYIPALSEV

SEQ ID NO: 27642 - protein, 17 aa, Brucella spp.
QPERLCLFEYVYFARPD

SEQ ID NO: 27643 - protein, 22 aa, Brucella spp.
IRNPDLIWPGQVFVMPKEPLRD

SEQ ID NO: 27644 - protein, 18 aa, Brucella spp.
GSRRYIWWNFVASSKERI

SEQ ID NO: 27645 - protein, 23 aa, Brucella spp.
SLAKPVMIALGALLIGKLLKGNS

SEQ ID NO: 27646 - protein, 21 aa, Brucella spp.
TRLYWHPIYLEHLTPPGHPER

SEQ ID NO: 27647 - protein, 17 aa, Brucella spp.
ECQVLMMRLNSDLLALV

SEQ ID NO: 27648 - protein, 18 aa, Brucella spp.
LMMRLNSDLLALVNAAVD

SEQ ID NO: 27649 - protein, 17 aa, Brucella spp.
LLLSQEWKFPLLPLFRS

SEQ ID NO: 27650 - protein, 24 aa, Brucella spp.
LSQEWKFPLLPLFRSAFAALQEGQ

SEQ ID NO: 27651 - protein, 23 aa, Brucella spp.
SKGMKFFPFVFSLFMFVLVANFI

SEQ ID NO: 27652 - protein, 25 aa, Brucella spp.
PHKQHWLVPFVLAASAYLFNSNAIA

SEQ ID NO: 27653 - protein, 24 aa, Brucella spp.
NPMPRWWLWTFYATIFWAIAYVIA

SEQ ID NO: 27654 - protein, 17 aa, Brucella spp.
RFKWIVMFITLGIYYLT

SEQ ID NO: 27655 - protein, 21 aa, Brucella spp.
RFYFFFIEIWPQEFYYVAGLL

SEQ ID NO: 27656 - protein, 17 aa, Brucella spp.
GRNSEFLLSFALDIDGY

SEQ ID NO: 27657 - protein, 20 aa, Brucella spp.
NSEFLLSFALDIDGYANIHA

SEQ ID NO: 27658 - protein, 17 aa, Brucella spp.
IVTSFLPFWEKTRLWVI

SEQ ID NO: 27659 - protein, 24 aa, Brucella spp.
YRRFPLWWLTPLAVTPLLLMALVI

SEQ ID NO: 27660 - protein, 19 aa, Brucella spp.
ANLPFILFESGFALNHIIL

SEQ ID NO: 27661 - protein, 18 aa, Brucella spp.
FILFESGFALNHIILSAC

SEQ ID NO: 27662 - protein, 17 aa, Brucella spp.
RLLYRLFHERGVRVFDS

SEQ ID NO: 27663 - protein, 17 aa, Brucella spp.
LYRLFHERGVRVFDSIA

SEQ ID NO: 27664 - protein, 23 aa, Brucella spp.
GDRVAIMMPNILQYPITFTAVLR

SEQ ID NO: 27665 - protein, 17 aa, Brucella spp.
ALPLYHIFALTVNAMIG

SEQ ID NO: 27666 - protein, 19 aa, Brucella spp.
VDPYHLIFTIWAVTQHYSD

SEQ ID NO: 27667 - protein, 17 aa, Brucella spp.
LIFTIWAVTQHYSDFAV

SEQ ID NO: 27668 - protein, 18 aa, Brucella spp.
THGQGLWWLQVTLTGKEA

SEQ ID NO: 27669 - protein, 19 aa, Brucella spp.
LCLLIILAATGGWYVYKNN

SEQ ID NO: 27670 - protein, 25 aa, Brucella spp.
EVETPAFWMTFKCAVMNLPYGGGKG

SEQ ID NO: 27671 - protein, 20 aa, Brucella spp.
FRILFTTHPTPMWVYDPETL

SEQ ID NO: 27672 - protein, 18 aa, Brucella spp.
HPTPMWVYDPETLRFIVM

SEQ ID NO: 27673 - protein, 18 aa, Brucella spp.
PMWVYDPETLRFIVMNDA

SEQ ID NO: 27674 - protein, 25 aa, Brucella spp.
LSRPVRLLHPRIPLYIVPRGDGIHM

SEQ ID NO: 27675 - protein, 17 aa, Brucella spp.
GLRPAWLLRLGLFLYDH

SEQ ID NO: 27676 - protein, 17 aa, Brucella spp.
AWLLRLGLFLYDHLGGR

SEQ ID NO: 27677 - protein, 18 aa, Brucella spp.
DFIRQFKVDFAIIGTSAI

SEQ ID NO: 27678 - protein, 19 aa, Brucella spp.
IIDKWRPVPVVFLAEREEW

SEQ ID NO: 27679 - protein, 18 aa, Brucella spp.
EIARYIDWTPFFQTWELR

SEQ ID NO: 27680 - protein, 19 aa, Brucella spp.
RYIDWTPFFQTWELRGRYP

SEQ ID NO: 27681 - protein, 24 aa, Brucella spp.
EDQFKPLRLMNGLYLQLHAYMLRV

SEQ ID NO: 27682 - protein, 17 aa, Brucella spp.
LARRGFWRTFFSGKVAR

SEQ ID NO: 27683 - protein, 17 aa, Brucella spp.
FWRTFFSGKVARAVESG

SEQ ID NO: 27684 - protein, 23 aa, Brucella spp.
TPRGVFELRYFFTASLASSEGGE

SEQ ID NO: 27685 - protein, 18 aa, Brucella spp.
VLFTVLLFLAIAMELSMP

SEQ ID NO: 27686 - protein, 29 aa, Brucella spp.
DGAHIRTLLLTFFFRQMPELIERGHIYIA

SEQ ID NO: 27687 - protein, 20 aa, Brucella spp.
DGSGYIFRAYHALPPLTRKT

SEQ ID NO: 27688 - protein, 18 aa, Brucella spp.
IFRAYHALPPLTRKTDGL

SEQ ID NO: 27689 - protein, 17 aa, Brucella spp.
TLRLWQVLKPRLAAEGL

SEQ ID NO: 27690 - protein, 18 aa, Brucella spp.
SITKIFHFGRFDLAVLAH

SEQ ID NO: 27691 - protein, 25 aa, Brucella spp.
TDFYKLLMLQMIWGLYPRVDATFSL

SEQ ID NO: 27692 - protein, 26 aa, Brucella spp.
TSPDTLLFYFQLMWPAMAIAGLAIFF

SEQ ID NO: 27693 - protein, 25 aa, Brucella spp.
LIAAPFVVIWFASPLIAWLVSRSAK

SEQ ID NO: 27694 - protein, 24 aa, Brucella spp.
GESVWLGWFLAYTLKAFIPLAEAR

SEQ ID NO: 27695 - protein, 24 aa, Brucella spp.
QRGRPALFYLGLAILLIAALAGLA

SEQ ID NO: 27696 - protein, 24 aa, Brucella spp.
MRISQLWHWLYVRGVSDFADMRNI

SEQ ID NO: 27697 - protein, 17 aa, Brucella spp.
IIPWEMTWSLYLEELGP

SEQ ID NO: 27698 - protein, 21 aa, Brucella spp.
AFFVFVVAAAVFAWPEQKVQM

SEQ ID NO: 27699 - protein, 19 aa, Brucella spp.
CLSLFWHFLDIIWIGVFTL

SEQ ID NO: 27700 - protein, 23 aa, Brucella spp.
PFGFAMIWHIWWLAIASALAMFV

SEQ ID NO: 27701 - protein, 19 aa, Brucella spp.
MVATIKIIPFAVPGVLIEE

SEQ ID NO: 27702 - protein, 20 aa, Brucella spp.
GEYFLPIHFQLMVLPGVRRE

SEQ ID NO: 27703 - protein, 18 aa, Brucella spp.
PPHVKFIFATTEIRKVPI

SEQ ID NO: 27704 - protein, 17 aa, Brucella spp.
VKFIFATTEIRKVPITV

SEQ ID NO: 27705 - protein, 25 aa, Brucella spp.
KPGFFQLVPWFIIGFLAMMALHSLH

SEQ ID NO: 27706 - protein, 25 aa, Brucella spp.
IRDVTPLMHVPQPFEILKMDKRRGN

SEQ ID NO: 27707 - protein, 25 aa, Brucella spp.
WSLSALFFMYLAFPFFDLLCRRLGN

SEQ ID NO: 27708 - protein, 18 aa, Brucella spp.
IFILHPLVALFFFKATPE

SEQ ID NO: 27709 - protein, 23 aa, Brucella spp.
RAYSPRFLWTWPNSRIAVMGGEQ

SEQ ID NO: 27710 - protein, 25 aa, Brucella spp.
GLRPDRFFFMEMNTRLQVEHPVTEA

SEQ ID NO: 27711 - protein, 28 aa, Brucella spp.
AEQQGIEIRYYNIIYDLIDDVKAAMSGL

SEQ ID NO: 27712 - protein, 18 aa, Brucella spp.
DLMPAPIYYSHKILEKLA

SEQ ID NO: 27713 - protein, 20 aa, Brucella spp.
AEWLRTFIFTGFPWNLIGYA

SEQ ID NO: 27714 - protein, 24 aa, Brucella spp.
EKVDPYLRPLYDALYDMMPAEKVE

SEQ ID NO: 27715 - protein, 24 aa, Brucella spp.
LVGSLYMMLIVLGLSLPIGVAASI

SEQ ID NO: 27716 - protein, 24 aa, Brucella spp.
PHYHGWWVFLVSALPALLFLAIWA

SEQ ID NO: 27717 - protein, 17 aa, Brucella spp.
SRPLYFYVKKAHLGVIP

SEQ ID NO: 27718 - protein, 17 aa, Brucella spp.
YFYVKKAHLGVIPGLKE

SEQ ID NO: 27719 - protein, 24 aa, Brucella spp.
GDVKDVLLLDVTPLSLGIETLGGV

SEQ ID NO: 27720 - protein, 22 aa, Brucella spp.
PSPKWMQQRLKAIGLRPINALV

SEQ ID NO: 27721 - protein, 32 aa, Brucella spp.
SIDPAFVLPLVALFFLIRLFGPSLAVIAVLVL

SEQ ID NO: 27722 - protein, 22 aa, Brucella spp.
KDRLRFFFDNGEYTTLEAPKVP

SEQ ID NO: 27723 - protein, 22 aa, Brucella spp.
DLVGEPFFILNADTFWVGDEAE

SEQ ID NO: 27724 - protein, 24 aa, Brucella spp.
SEKSLLLRDYHSPNLFWLAGAQGK

SEQ ID NO: 27725 - protein, 17 aa, Brucella spp.
DQGFEWLHVVDLNGAFA

SEQ ID NO: 27726 - protein, 17 aa, Brucella spp.
EWLHVVDLNGAFAGESV

SEQ ID NO: 27727 - protein, 23 aa, Brucella spp.
PVKTDHILFITSGAFHVSKPSDL

SEQ ID NO: 27728 - protein, 23 aa, Brucella spp.
NRFSAVFFQPFYAGQTFGLGQIN

SEQ ID NO: 27729 - protein, 17 aa, Brucella spp.
VPHWFSTPLFRLLVSAY

SEQ ID NO: 27730 - protein, 17 aa, Brucella spp.
HWFSTPLFRLLVSAYED

SEQ ID NO: 27731 - protein, 20 aa, Brucella spp.
DFMIKPLIFERVQVSVANVL

SEQ ID NO: 27732 - protein, 27 aa, Brucella spp.
YETFWTYIPHFIHSPFYVYAYAFGDCL

SEQ ID NO: 27733 - protein, 23 aa, Brucella spp.
WGGDPLILFNMLAKRQPVRYATY

SEQ ID NO: 27734 - protein, 25 aa, Brucella spp.
VIEWSRLIWYPILYGIVLNTRPRRS

SEQ ID NO: 27735 - protein, 23 aa, Brucella spp.
IAGTEFFIKADLAFIAIGFAGPV

SEQ ID NO: 27736 - protein, 26 aa, Brucella spp.
TPEHVINFFFYLAEEVRALLAQMGFT

SEQ ID NO: 27737 - protein, 22 aa, Brucella spp.
IAAAVFYTVVILLSARLLTGKA

SEQ ID NO: 27738 - protein, 24 aa, Brucella spp.
AAVATVFIIAVNALLRPLVQVLEF

SEQ ID NO: 27739 - protein, 24 aa, Brucella spp.
VSWLLIRFMLIMVPVVFLINGFTK

SEQ ID NO: 27740 - protein, 17 aa, Brucella spp.
FFAWVLVATLLLWFTSS

SEQ ID NO: 27741 - protein, 18 aa, Brucella spp.
SGSRFFFSPLINVLPFST

SEQ ID NO: 27742 - protein, 19 aa, Brucella spp.
RFFFSPLINVLPFSTPQFA

SEQ ID NO: 27743 - protein, 24 aa, Brucella spp.
NIAEFYIVFFALMKAGIAPVNALF

SEQ ID NO: 27744 - protein, 19 aa, Brucella spp.
ERGPKIVILKLGSRGALLV

SEQ ID NO: 27745 - protein, 18 aa, Brucella spp.
IVILKLGSRGALLVTADE

SEQ ID NO: 27746 - protein, 17 aa, Brucella spp.
DGFDWLLMLHGTSGHNY

SEQ ID NO: 27747 - protein, 25 aa, Brucella spp.
FTLNARYIWNYTTIGATFTKAKVTA

SEQ ID NO: 27748 - protein, 19 aa, Brucella spp.
WVQFFRMIPPLAVIPLAIV

SEQ ID NO: 27749 - protein, 24 aa, Brucella spp.
GPERGVIFQQYALFPWLTVRQNVE

SEQ ID NO: 27750 - protein, 18 aa, Brucella spp.
WFLHVNLWDPHTPYRVPE

SEQ ID NO: 27751 - protein, 24 aa, Brucella spp.
VADLSPMIWYPTTFLEGHKEAMGD

SEQ ID NO: 27752 - protein, 25 aa, Brucella spp.
ITPWNTPFMLSTWKIAPALAAGCTV

SEQ ID NO: 27753 - protein, 17 aa, Brucella spp.
LSYDRLILNADIDAYIS

SEQ ID NO: 27754 - protein, 18 aa, Brucella spp.
LARKVPLLIAPAMNPAMW

SEQ ID NO: 27755 - protein, 17 aa, Brucella spp.
WPHILFVLSIVLGAIAA

SEQ ID NO: 27756 - protein, 24 aa, Brucella spp.
TGARVWPYYLHTIQPHVLREETVL

SEQ ID NO: 27757 - protein, 20 aa, Brucella spp.
VGMMFYMDPVLSVAIFLIGP

SEQ ID NO: 27758 - protein, 18 aa, Brucella spp.
ELIPQHMFKIPIQAAIGG

SEQ ID NO: 27759 - protein, 17 aa, Brucella spp.
ALLAWLFTPITLLQLFF

SEQ ID NO: 27760 - protein, 24 aa, Brucella spp.
LFKKSWIFIRGVPSMKFLPPEGPV

SEQ ID NO: 27761 - protein, 23 aa, Brucella spp.
LLIDWGWFYFITKPMFYLIDWIY

SEQ ID NO: 27762 - protein, 24 aa, Brucella spp.
ESGRYRILQRLDPPPIVPDADRIA

SEQ ID NO: 27763 - protein, 28 aa, Brucella spp.
ILAGTPFHIIIGLLLIPYFLSNIQMANG

SEQ ID NO: 27764 - protein, 25 aa, Brucella spp.
NTESHFVFWLIVLLSLVFGVLIIVP

SEQ ID NO: 27765 - protein, 24 aa, Brucella spp.
QGDDKWFNIVRWTLFALLEAEELG

SEQ ID NO: 27766 - protein, 23 aa, Brucella spp.
SIRSHIPFLFEGKLPDFNIGTDM

SEQ ID NO: 27767 - protein, 22 aa, Brucella spp.
DSFWSWREIMYKFALTMTPEQA

SEQ ID NO: 27768 - protein, 23 aa, Brucella spp.
LGKTYYFDLARPGIALYGIDPER

SEQ ID NO: 27769 - protein, 18 aa, Brucella spp.
FWFQLYVMRDRDFVKNLI

SEQ ID NO: 27770 - protein, 18 aa, Brucella spp.
AFLYQLFVRAYGTNNFPD

SEQ ID NO: 27771 - protein, 26 aa, Brucella spp.
AGTAITLLFLPALYVAWFRIKEPEHS

SEQ ID NO: 27772 - protein, 25 aa, Brucella spp.
HCLNDLLYRWKIGALPIDIVGVVSN

SEQ ID NO: 27773 - protein, 29 aa, Brucella spp.
PGDRWLMEVAGWAWRVKLSLTLSLDLMRD

SEQ ID NO: 27774 - protein, 23 aa, Brucella spp.
KGRKQFVLWLDAHTDFHTLETTT

SEQ ID NO: 27775 - protein, 23 aa, Brucella spp.
GSGYPMLLTEMTILTALRTAATS

SEQ ID NO: 27776 - protein, 17 aa, Brucella spp.
ANDIMLRHMMDAVTEIY

SEQ ID NO: 27777 - protein, 20 aa, Brucella spp.
DIMLRHMMDAVTEIYPHIPV

SEQ ID NO: 27778 - protein, 25 aa, Brucella spp.
LNAAPHIIWPMRFVLPHSPQDRPAW

SEQ ID NO: 27779 - protein, 24 aa, Brucella spp.
GATINIDWILQVAADLMSTPEKPV

SEQ ID NO: 27780 - protein, 22 aa, Brucella spp.
QEFGIILYFPVWAVVLITCALG

SEQ ID NO: 27781 - protein, 24 aa, Brucella spp.
SNPVPVHWFFEMDLDFGISDPSII

SEQ ID NO: 27782 - protein, 22 aa, Brucella spp.
IYACWLIFRLCCIPLFEQRERL

SEQ ID NO: 27783 - protein, 22 aa, Brucella spp.
APAFLKLWLDINEHKLLGEIET

SEQ ID NO: 27784 - protein, 23 aa, Brucella spp.
SSDYKIYIFGFLFLKRLSDRFEE

SEQ ID NO: 27785 - protein, 17 aa, Brucella spp.
LLPDRFVKWFAAKGWSP

SEQ ID NO: 27786 - protein, 27 aa, Brucella spp.
DILHRQRKPILFAIGAVMIAIAGLQVG

SEQ ID NO: 27787 - protein, 23 aa, Brucella spp.
SGGAWYMDPSVGFPGYFMPQGVS

SEQ ID NO: 27788 - protein, 24 aa, Brucella spp.
PKNFIGIHFFSPVDKMMLVEVILG

SEQ ID NO: 27789 - protein, 23 aa, Brucella spp.
SGPAYIFHFIEALTDAGVNLGLP

SEQ ID NO: 27790 - protein, 23 aa, Brucella spp.
IVGKPMFNLLLAANATVTVAHSR

SEQ ID NO: 27791 - protein, 22 aa, Brucella spp.
GLTDIFLPYNILGQEKLDRLHA

SEQ ID NO: 27792 - protein, 28 aa, Brucella spp.
ALGPVVCISPWNFPLAIFTGQIAAALVA

SEQ ID NO: 27793 - protein, 22 aa, Brucella spp.
YGYEMYYLNVMAGPLRKWRFKN

SEQ ID NO: 27794 - protein, 24 aa, Brucella spp.
PGKWKVIFFYPKDFTFVCPTEIAE

SEQ ID NO: 27795 - protein, 25 aa, Brucella spp.
ITTFLTWHWIFLINVPIGMIGIWFA

SEQ ID NO: 27796 - protein, 17 aa, Brucella spp.
TPWNWPMNQITLKVIPA

SEQ ID NO: 27797 - protein, 22 aa, Brucella spp.
MRPWLLSLGMRWFPVVGWAERG

SEQ ID NO: 27798 - protein, 23 aa, Brucella spp.
LEEPFLQLAFIALPVIPHLKITD

SEQ ID NO: 27799 - protein, 23 aa, Brucella spp.
GRHQPLIFRIHGEPALAKQETLR

SEQ ID NO: 27800 - protein, 23 aa, Brucella spp.
RRALDYLVGFTLSPVLWRKLPGA

SEQ ID NO: 27801 - protein, 18 aa, Brucella spp.
TDAIQLILLELDLAGRLL

SEQ ID NO: 27802 - protein, 17 aa, Brucella spp.
LILLELDLAGRLLRYPG

SEQ ID NO: 27803 - protein, 23 aa, Brucella spp.
PVVKYWVCKIAPALLYEAMECLG

SEQ ID NO: 27804 - protein, 17 aa, Brucella spp.
DPVKMYLNDIFTVTVNM

SEQ ID NO: 27805 - protein, 17 aa, Brucella spp.
MYLNDIFTVTVNMAGLP

SEQ ID NO: 27806 - protein, 25 aa, Brucella spp.
HIASLLITFFYQEMPELIRNGHLYL

SEQ ID NO: 27807 - protein, 17 aa, Brucella spp.
LIRNGHLYLAVPPLYRL

SEQ ID NO: 27808 - protein, 20 aa, Brucella spp.
FFVQCWLMFFIILVVGGLRA

SEQ ID NO: 27809 - protein, 17 aa, Brucella spp.
HWLPLFYDNMETVFDHA

SEQ ID NO: 27810 - protein, 23 aa, Brucella spp.
DGRYTAMWWWLGLALFVDGIDGP

SEQ ID NO: 27811 - protein, 23 aa, Brucella spp.
GEMGVWVRMHYVYPYPHVDEVIP

SEQ ID NO: 27812 - protein, 19 aa, Brucella spp.
NDFIPMMILNENRIDTLFR

SEQ ID NO: 27813 - protein, 18 aa, Brucella spp.
LVIGYILRHHLSWMRLIE

SEQ ID NO: 27814 - protein, 23 aa, Brucella spp.
VLPLFWAFRIMVGIGFFLILLTG

SEQ ID NO: 27815 - protein, 19 aa, Brucella spp.
GFMHPLFGLLVALTLLVIG

SEQ ID NO: 27816 - protein, 24 aa, Brucella spp.
HFSAPRMIYFGSGYMANLAALSTL

SEQ ID NO: 27817 - protein, 17 aa, Brucella spp.
PGAIFWMWIVALVGLAT

SEQ ID NO: 27818 - protein, 23 aa, Brucella spp.
LLGVFIILWAWQLPPFKHSVETT

SEQ ID NO: 27819 - protein, 24 aa, Brucella spp.
LAGEPFVLFPRIVGLSLYDDIAAA

SEQ ID NO: 27820 - protein, 23 aa, Brucella spp.
ASPRLINWLLVGLGLGGLFAVAG

SEQ ID NO: 27821 - protein, 23 aa, Brucella spp.
TGGFTWLVTYFEPLVIYDDKLEN

SEQ ID NO: 27822 - protein, 22 aa, Brucella spp.
ERPRWPMIILRSPKGWTGPKTV

SEQ ID NO: 27823 - protein, 24 aa, Brucella spp.
TTNRPVIFAYHGYPYLIHRLVYKR

SEQ ID NO: 27824 - protein, 23 aa, Brucella spp.
LIEVLVFFAYWTIVLWFLSRPRA

SEQ ID NO: 27825 - protein, 24 aa, Brucella spp.
GNNTPVFFVRDPLKFPDFIHTQKR

SEQ ID NO: 27826 - protein, 25 aa, Brucella spp.
SVARDLLMYLLTTLGVEPVALGRSD

SEQ ID NO: 27827 - protein, 25 aa, Brucella spp.
TVTLYLIMYLLMFAAAIHLRYSEPN

SEQ ID NO: 27828 - protein, 24 aa, Brucella spp.
VFLESFLFYSGFYLPMYWSSRAKL

SEQ ID NO: 27829 - protein, 24 aa, Brucella spp.
AYARKFRFPTFLGAFKYYTSYTLK

SEQ ID NO: 27830 - protein, 25 aa, Brucella spp.
EYRTLPMVWYVPPFSPLQSAAQAGK

SEQ ID NO: 27831 - protein, 19 aa, Brucella spp.
VMMGLWSMLPQFSYTKLII

SEQ ID NO: 27832 - protein, 24 aa, Brucella spp.
AIGVWLFFVLIYDAALLVFDQGQT

SEQ ID NO: 27833 - protein, 24 aa, Brucella spp.
ETGNLLLRWHRLGPDLYETEAPAE

SEQ ID NO: 27834 - protein, 21 aa, Brucella spp.
PSYRLIPSCFPPIGLFDTVAT

SEQ ID NO: 27835 - protein, 24 aa, Brucella spp.
TFAAAWQFFDLTDFLTWKSCGSLA

SEQ ID NO: 27836 - protein, 19 aa, Brucella spp.
IIGLLIIWTVFQTLNPVFL

SEQ ID NO: 27837 - protein, 17 aa, Brucella spp.
IWTVFQTLNPVFLSSNN

SEQ ID NO: 27838 - protein, 17 aa, Brucella spp.
RGVPWMFALFVALVIAM

SEQ ID NO: 27839 - protein, 17 aa, Brucella spp.
WMFALFVALVIAMNYAL

SEQ ID NO: 27840 - protein, 17 aa, Brucella spp.
CALFEMAWQRKLPLLLK

SEQ ID NO: 27841 - protein, 20 aa, Brucella spp.
LFEMAWQRKLPLLLKGPTGC

SEQ ID NO: 27842 - protein, 17 aa, Brucella spp.
LDKLYWWYVIHLWVEGV

SEQ ID NO: 27843 - protein, 22 aa, Brucella spp.
RHPVAVLFLTLDPALVDVNVHP

SEQ ID NO: 27844 - protein, 18 aa, Brucella spp.
WWDEPDWRALALAPAAWI

SEQ ID NO: 27845 - protein, 18 aa, Brucella spp.
KMRYPRLITIIVPRHPDR

SEQ ID NO: 27846 - protein, 17 aa, Brucella spp.
IFRNTPQWFVYMDKNLG

SEQ ID NO: 27847 - protein, 25 aa, Brucella spp.
TVREIFVRLTTWLAPMLPFTMEEAW

SEQ ID NO: 27848 - protein, 17 aa, Brucella spp.
NVFKPVIAYNVLQSIRL

SEQ ID NO: 27849 - protein, 17 aa, Brucella spp.
LMPIICYAYIAFYGLIG

SEQ ID NO: 27850 - protein, 24 aa, Brucella spp.
DDEQWLSLRYDLTAPLARYVAENF

SEQ ID NO: 27851 - protein, 24 aa, Brucella spp.
YVDLYLIHWPMPSKDLFMETWRAF

SEQ ID NO: 27852 - protein, 23 aa, Brucella spp.
NNCQQFFFKYCSTFDSTPKGNIG

SEQ ID NO: 27853 - protein, 18 aa, Brucella spp.
IRRFNFDLAFISTSSFGA

SEQ ID NO: 27854 - protein, 17 aa, Brucella spp.
RGSIWLFWIVATLPWSP

SEQ ID NO: 27855 - protein, 23 aa, Brucella spp.
IQPWEFIIILGAALGTFFVANPF

SEQ ID NO: 27856 - protein, 23 aa, Brucella spp.
AASVIVFLVFFKGNSLFTDAVAT

SEQ ID NO: 27857 - protein, 25 aa, Brucella spp.
NIRKPRPIIFLIKAGAPVDTETTRL

SEQ ID NO: 27858 - protein, 6 aa, Brucella spp.
QGSSVS

SEQ ID NO: 27859 - protein, 6 aa, Brucella spp.
EKPLPQ

SEQ ID NO: 27860 - protein, 7 aa, Brucella spp.
KGMPRTS

SEQ ID NO: 27861 - protein, 8 aa, Brucella spp.
KNNGKYDQ

SEQ ID NO: 27862 - protein, 16 aa, Brucella spp.
KLGPKYIEGDRQAPEG

SEQ ID NO: 27863 - protein, 5 aa, Brucella spp.
QMNPH

SEQ ID NO: 27864 - protein, 9 aa, Brucella spp.
DRANGRTGQ

SEQ ID NO: 27865 - protein, 5 aa, Brucella spp.
SSSGC

SEQ ID NO: 27866 - protein, 8 aa, Brucella spp.
AFKGGQRE

SEQ ID NO: 27867 - protein, 8 aa, Brucella spp.
RYKNDPNY

SEQ ID NO: 27868 - protein, 7 aa, Brucella spp.
TTKVPPK

SEQ ID NO: 27869 - protein, 22 aa, Brucella spp.
PTPDGQPLSPTGACPPSVGGEA

SEQ ID NO: 27870 - protein, 12 aa, Brucella spp.
AAQKAPAPSIQG

SEQ ID NO: 27871 - protein, 39 aa, Brucella spp.
ARARGEKVTREPPSLSPASAEKPGAPDIRPATPAIQPTA

SEQ ID NO: 27872 - protein, 16 aa, Brucella spp.
ATAPQQAAPATPAPQI

SEQ ID NO: 27873 - protein, 18 aa, Brucella spp.
PVPQQNPAEATAVANPQM

SEQ ID NO: 27874 - protein, 17 aa, Brucella spp.
NIEQPGPKKPWWKIIGN

SEQ ID NO: 27875 - protein, 12 aa, Brucella spp.
VKAQGADGGIAA

SEQ ID NO: 27876 - protein, 5 aa, Brucella spp.
ARTMT

SEQ ID NO: 27877 - protein, 9 aa, Brucella spp.
GPRGEQTGG

SEQ ID NO: 27878 - protein, 5 aa, Brucella spp.
GGGRL

SEQ ID NO: 27879 - protein, 8 aa, Brucella spp.
SVKQEPDM

SEQ ID NO: 27880 - protein, 5 aa, Brucella spp.
SVFGD

SEQ ID NO: 27881 - protein, 4 aa, Brucella spp.
QKLD

SEQ ID NO: 27882 - protein, 8 aa, Brucella spp.
NTAPLPKE

SEQ ID NO: 27883 - protein, 9 aa, Brucella spp.
RSAETLKRA

SEQ ID NO: 27884 - protein, 14 aa, Brucella spp.
GDSYTTNSAEAVKD

SEQ ID NO: 27885 - protein, 9 aa, Brucella spp.
VGSSGTVAR

SEQ ID NO: 27886 - protein, 5 aa, Brucella spp.
NLKPG

SEQ ID NO: 27887 - protein, 7 aa, Brucella spp.
VGSTKAS

SEQ ID NO: 27888 - protein, 11 aa, Brucella spp.
AGTEYSGPDAG

SEQ ID NO: 27889 - protein, 9 aa, Brucella spp.
LPDTDEKAL

SEQ ID NO: 27890 - protein, 5 aa, Brucella spp.
ASDPT

SEQ ID NO: 27891 - protein, 12 aa, Brucella spp.
GQEVDTPDFGRQ

SEQ ID NO: 27892 - protein, 16 aa, Brucella spp.
VRSTAPLKAPEGDPAE

SEQ ID NO: 27893 - protein, 5 aa, Brucella spp.
QRHKK

SEQ ID NO: 27894 - protein, 21 aa, Brucella spp.
SLTGSALTDDVDVPDGHYAEE

SEQ ID NO: 27895 - protein, 6 aa, Brucella spp.
AQKADA

SEQ ID NO: 27896 - protein, 7 aa, Brucella spp.
AKYRTPF

SEQ ID NO: 27897 - protein, 8 aa, Brucella spp.
DDPTSYED

SEQ ID NO: 27898 - protein, 7 aa, Brucella spp.
QRPEGKQ

SEQ ID NO: 27899 - protein, 10 aa, Brucella spp.
GKVEPGEMPE

SEQ ID NO: 27900 - protein, 5 aa, Brucella spp.
RGLEG

SEQ ID NO: 27901 - protein, 18 aa, Brucella spp.
YPMPPADEPLIPFLVDLL

SEQ ID NO: 27902 - protein, 9 aa, Brucella spp.
EGTPQGKGL

SEQ ID NO: 27903 - protein, 9 aa, Brucella spp.
IAESSPVDG

SEQ ID NO: 27904 - protein, 6 aa, Brucella spp.
FTGAND

SEQ ID NO: 27905 - protein, 9 aa, Brucella spp.
VPRKPGMSR

SEQ ID NO: 27906 - protein, 4 aa, Brucella spp.
KYAP

SEQ ID NO: 27907 - protein, 5 aa, Brucella spp.
TSQDK

SEQ ID NO: 27908 - protein, 8 aa, Brucella spp.
RTRDGGAE

SEQ ID NO: 27909 - protein, 4 aa, Brucella spp.
YAPA

SEQ ID NO: 27910 - protein, 5 aa, Brucella spp.
SGQYG

SEQ ID NO: 27911 - protein, 10 aa, Brucella spp.
KDEKAQFDKS

SEQ ID NO: 27912 - protein, 6 aa, Brucella spp.
RDRDEA

SEQ ID NO: 27913 - protein, 7 aa, Brucella spp.
RPEQPND

SEQ ID NO: 27914 - protein, 8 aa, Brucella spp.
MTPAPTNE

SEQ ID NO: 27915 - protein, 8 aa, Brucella spp.
ANDKPGFK

SEQ ID NO: 27916 - protein, 10 aa, Brucella spp.
KGDGSEPEDL

SEQ ID NO: 27917 - protein, 7 aa, Brucella spp.
DGAEAEV

SEQ ID NO: 27918 - protein, 9 aa, Brucella spp.
PKADEPAAQ

SEQ ID NO: 27919 - protein, 9 aa, Brucella spp.
GAAKPEKPL

SEQ ID NO: 27920 - protein, 12 aa, Brucella spp.
AAARAGQAPCTS

SEQ ID NO: 27921 - protein, 7 aa, Brucella spp.
EKSKPAL

SEQ ID NO: 27922 - protein, 9 aa, Brucella spp.
EAAATPNSK

SEQ ID NO: 27923 - protein, 6 aa, Brucella spp.
DGVEPS

SEQ ID NO: 27924 - protein, 10 aa, Brucella spp.
QAASEAYDSA

SEQ ID NO: 27925 - protein, 5 aa, Brucella spp.
TTLES

SEQ ID NO: 27926 - protein, 9 aa, Brucella spp.
LPKERRADI

SEQ ID NO: 27927 - protein, 10 aa, Brucella spp.
KCERARKARG

SEQ ID NO: 27928 - protein, 10 aa, Brucella spp.
AQKQGREVKG

SEQ ID NO: 27929 - protein, 7 aa, Brucella spp.
KIEDSME

SEQ ID NO: 27930 - protein, 5 aa, Brucella spp.
EDLSD

SEQ ID NO: 27931 - protein, 4 aa, Brucella spp.
PGKE

SEQ ID NO: 27932 - protein, 7 aa, Brucella spp.
AAKGGHE

SEQ ID NO: 27933 - protein, 8 aa, Brucella spp.
KDRRNPRY

SEQ ID NO: 27934 - protein, 8 aa, Brucella spp.
IRASTDAA

SEQ ID NO: 27935 - protein, 7 aa, Brucella spp.
IEQNTGR

SEQ ID NO: 27936 - protein, 7 aa, Brucella spp.
SGPSFAS

SEQ ID NO: 27937 - protein, 5 aa, Brucella spp.
RGLPT

SEQ ID NO: 27938 - protein, 8 aa, Brucella spp.
EDANTADR

SEQ ID NO: 27939 - protein, 9 aa, Brucella spp.
LKGVETGGA

SEQ ID NO: 27940 - protein, 12 aa, Brucella spp.
AIGRGYGASAQA

SEQ ID NO: 27941 - protein, 6 aa, Brucella spp.
SARPET

SEQ ID NO: 27942 - protein, 8 aa, Brucella spp.
SSQSRNYS

SEQ ID NO: 27943 - protein, 13 aa, Brucella spp.
RGEDLTSRPLAEG

SEQ ID NO: 27944 - protein, 4 aa, Brucella spp.
ATAP

SEQ ID NO: 27945 - protein, 16 aa, Brucella spp.
APASTAFAAGKDSDVY

SEQ ID NO: 27946 - protein, 8 aa, Brucella spp.
VTPPDDKK

SEQ ID NO: 27947 - protein, 15 aa, Brucella spp.
DPHSSYLNPEAAQDM

SEQ ID NO: 27948 - protein, 7 aa, Brucella spp.
TKGEFGG

SEQ ID NO: 27949 - protein, 11 aa, Brucella spp.
DDTPASKAGVL

SEQ ID NO: 27950 - protein, 6 aa, Brucella spp.
DGQEVR

SEQ ID NO: 27951 - protein, 7 aa, Brucella spp.
MRGEVGA

SEQ ID NO: 27952 - protein, 7 aa, Brucella spp.
GADKPIT

SEQ ID NO: 27953 - protein, 5 aa, Brucella spp.
RSRVE

SEQ ID NO: 27954 - protein, 8 aa, Brucella spp.
EQTSEDLK

SEQ ID NO: 27955 - protein, 8 aa, Brucella spp.
EKVPADKL

SEQ ID NO: 27956 - protein, 11 aa, Brucella spp.
VSTRGRDPQDV

SEQ ID NO: 27957 - protein, 7 aa, Brucella spp.
GDLTNGK

SEQ ID NO: 27958 - protein, 8 aa, Brucella spp.
GSASASEI

SEQ ID NO: 27959 - protein, 8 aa, Brucella spp.
QSFGKGSV

SEQ ID NO: 27960 - protein, 5 aa, Brucella spp.
ENGSL

SEQ ID NO: 27961 - protein, 15 aa, Brucella spp.
TPSGKSIQGKGITPD

SEQ ID NO: 27962 - protein, 8 aa, Brucella spp.
QPLPPELK

SEQ ID NO: 27963 - protein, 13 aa, Brucella spp.
EDVVRGESELKGH

SEQ ID NO: 27964 - protein, 26 aa, Brucella spp.
IKGNAEDASGSGSSAYVPPDPKDDLQ

SEQ ID NO: 27965 - protein, 13 aa, Brucella spp.
AAFPPDPKKGVLN

SEQ ID NO: 27966 - protein, 14 aa, Brucella spp.
IPTNEEKAKAAWSE

SEQ ID NO: 27967 - protein, 6 aa, Brucella spp.
NQYQRR

SEQ ID NO: 27968 - protein, 7 aa, Brucella spp.
AAHEKET

SEQ ID NO: 27969 - protein, 7 aa, Brucella spp.
AKATQVQ

SEQ ID NO: 27970 - protein, 7 aa, Brucella spp.
TPETLNN

SEQ ID NO: 27971 - protein, 8 aa, Brucella spp.
DNQANLTS

SEQ ID NO: 27972 - protein, 5 aa, Brucella spp.
PDLKA

SEQ ID NO: 27973 - protein, 8 aa, Brucella spp.
QLEGTENR

SEQ ID NO: 27974 - protein, 6 aa, Brucella spp.
QPMPTF

SEQ ID NO: 27975 - protein, 14 aa, Brucella spp.
ADAGSQAAPKVNFN

SEQ ID NO: 27976 - protein, 4 aa, Brucella spp.
VPAN

SEQ ID NO: 27977 - protein, 10 aa, Brucella spp.
PAAAASSQSM

SEQ ID NO: 27978 - protein, 4 aa, Brucella spp.
REEE

SEQ ID NO: 27979 - protein, 7 aa, Brucella spp.
ETKDQDA

SEQ ID NO: 27980 - protein, 6 aa, Brucella spp.
RFDPDR

SEQ ID NO: 27981 - protein, 7 aa, Brucella spp.
GGTSSAQ

SEQ ID NO: 27982 - protein, 11 aa, Brucella spp.
KLAQTDDNMTK

SEQ ID NO: 27983 - protein, 6 aa, Brucella spp.
LGVSTS

SEQ ID NO: 27984 - protein, 21 aa, Brucella spp.
LSGPDSSLSASMNGEETGASR

SEQ ID NO: 27985 - protein, 5 aa, Brucella spp.
AESSI

SEQ ID NO: 27986 - protein, 6 aa, Brucella spp.
LDDDGV

SEQ ID NO: 27987 - protein, 18 aa, Brucella spp.
INSSKDLGLQPSSNPVTV

SEQ ID NO: 27988 - protein, 4 aa, Brucella spp.
ARND

SEQ ID NO: 27989 - protein, 4 aa, Brucella spp.
AQQH

SEQ ID NO: 27990 - protein, 9 aa, Brucella spp.
GGEYKDPKL

SEQ ID NO: 27991 - protein, 11 aa, Brucella spp.
TTASDKPDQTY

SEQ ID NO: 27992 - protein, 6 aa, Brucella spp.
NDSSEV

SEQ ID NO: 27993 - protein, 8 aa, Brucella spp.
QEKEAEAA

SEQ ID NO: 27994 - protein, 9 aa, Brucella spp.
KAAGREAEI

SEQ ID NO: 27995 - protein, 6 aa, Brucella spp.
RNQELQ

SEQ ID NO: 27996 - protein, 5 aa, Brucella spp.
GYDPF

SEQ ID NO: 27997 - protein, 8 aa, Brucella spp.
VSGATDAS

SEQ ID NO: 27998 - protein, 7 aa, Brucella spp.
HPATPQR

SEQ ID NO: 27999 - protein, 12 aa, Brucella spp.
IGAPGVGTTDRD

SEQ ID NO: 28000 - protein, 9 aa, Brucella spp.
GDSPNEGYV

SEQ ID NO: 28001 - protein, 6 aa, Brucella spp.
ASGPGE

SEQ ID NO: 28002 - protein, 10 aa, Brucella spp.
ASLPSASSLT

SEQ ID NO: 28003 - protein, 7 aa, Brucella spp.
NSIRQTT

SEQ ID NO: 28004 - protein, 12 aa, Brucella spp.
LPAATARASADR

SEQ ID NO: 28005 - protein, 16 aa, Brucella spp.
APKGSSALLPASQAVT

SEQ ID NO: 28006 - protein, 7 aa, Brucella spp.
PAEQSAI

SEQ ID NO: 28007 - protein, 6 aa, Brucella spp.
KPGDTM

SEQ ID NO: 28008 - protein, 5 aa, Brucella spp.
MQGAT

SEQ ID NO: 28009 - protein, 16 aa, Brucella spp.
AGATVSVGDRVKIISE

SEQ ID NO: 28010 - protein, 7 aa, Brucella spp.
PAAQAKD

SEQ ID NO: 28011 - protein, 12 aa, Brucella spp.
WGPGPKVKENFE

SEQ ID NO: 28012 - protein, 7 aa, Brucella spp.
EGSKTAA

SEQ ID NO: 28013 - protein, 7 aa, Brucella spp.
LTTEARA

SEQ ID NO: 28014 - protein, 7 aa, Brucella spp.
SGIDQTN

SEQ ID NO: 28015 - protein, 6 aa, Brucella spp.
KVPGNF

SEQ ID NO: 28016 - protein, 10 aa, Brucella spp.
EKLPNPPKSL

SEQ ID NO: 28017 - protein, 7 aa, Brucella spp.
VEGDPAQ

SEQ ID NO: 28018 - protein, 8 aa, Brucella spp.
DPRTATPG

SEQ ID NO: 28019 - protein, 8 aa, Brucella spp.
GDEAGAAW

SEQ ID NO: 28020 - protein, 4 aa, Brucella spp.
YPEG

SEQ ID NO: 28021 - protein, 12 aa, Brucella spp.
AQTTTGAKNPLA

SEQ ID NO: 28022 - protein, 9 aa, Brucella spp.
GKTSKPLPA

SEQ ID NO: 28023 - protein, 6 aa, Brucella spp.
LPKPEK

SEQ ID NO: 28024 - protein, 13 aa, Brucella spp.
SPKAFDVQDSESF

SEQ ID NO: 28025 - protein, 91 aa, Brucella spp.
QIQQGDKKAPMKEKSAPVPTTRPQTVPNAENFGDQEVDTKTPPKPDAKAKPIETAEEPKAQPEPVKKPEPKPDPKPEPKPEEKPTPVPANE

SEQ ID NO: 28026 - protein, 18 aa, Brucella spp.
MQAEPEPKQEVKPDPVAE

SEQ ID NO: 28027 - protein, 11 aa, Brucella spp.
EKQAEAPDAEA

SEQ ID NO: 28028 - protein, 48 aa, Brucella spp.
DRVPAPKAKPKPPQAQTAKTNERKQPEEKKKTQSASQTSQSKNDAIAD

SEQ ID NO: 28029 - protein, 33 aa, Brucella spp.
QKASGGGAKRSTDQASLGGKKNTGGSKLSQSEM

SEQ ID NO: 28030 - protein, 5 aa, Brucella spp.
VADAP

SEQ ID NO: 28031 - protein, 31 aa, Brucella spp.
AEDGSIQGTPEVTSGGGADGVARAAAESARR

SEQ ID NO: 28032 - protein, 6 aa, Brucella spp.
QLGSNI

SEQ ID NO: 28033 - protein, 9 aa, Brucella spp.
SNPDAAPRF

SEQ ID NO: 28034 - protein, 8 aa, Brucella spp.
TKQPDGRL

SEQ ID NO: 28035 - protein, 6 aa, Brucella spp.
GDKGYF

SEQ ID NO: 28036 - protein, 8 aa, Brucella spp.
ESGPAQKR

SEQ ID NO: 28037 - protein, 7 aa, Brucella spp.
RFSPNRQ

SEQ ID NO: 28038 - protein, 6 aa, Brucella spp.
EGGSPK

SEQ ID NO: 28039 - protein, 5 aa, Brucella spp.
TGQRE

SEQ ID NO: 28040 - protein, 7 aa, Brucella spp.
RFSPDGQ

SEQ ID NO: 28041 - protein, 6 aa, Brucella spp.
DDGSAN

SEQ ID NO: 28042 - protein, 24 aa, Brucella spp.
NRTTTRLTSSQAIDTGASYSPDGS

SEQ ID NO: 28043 - protein, 8 aa, Brucella spp.
SDRGGRPQ

SEQ ID NO: 28044 - protein, 8 aa, Brucella spp.
DGSNPRRI

SEQ ID NO: 28045 - protein, 12 aa, Brucella spp.
GDGSYSTPVWSP

SEQ ID NO: 28046 - protein, 7 aa, Brucella spp.
KQSQGQF

SEQ ID NO: 28047 - protein, 8 aa, Brucella spp.
TDGSGERL

SEQ ID NO: 28048 - protein, 9 aa, Brucella spp.
NEGPTWAPN

SEQ ID NO: 28049 - protein, 7 aa, Brucella spp.
AGAGGPK

SEQ ID NO: 28050 - protein, 23 aa, Brucella spp.
GRNERQIQTPNFASDPAWSPLLE

SEQ ID NO: 28051 - protein, 28 aa, Brucella spp.
ASKKNLPNNAGDLGLGAGAATPGSSQDF

SEQ ID NO: 28052 - protein, 9 aa, Brucella spp.
DAQQTLSKQ

SEQ ID NO: 28053 - protein, 9 aa, Brucella spp.
HADERGTRE

SEQ ID NO: 28054 - protein, 7 aa, Brucella spp.
RRAAATR

SEQ ID NO: 28055 - protein, 6 aa, Brucella spp.
RGVPTN

SEQ ID NO: 28056 - protein, 6 aa, Brucella spp.
YGNERP

SEQ ID NO: 28057 - protein, 7 aa, Brucella spp.
SVSSQEK

SEQ ID NO: 28058 - protein, 8 aa, Brucella spp.
AGDPGMSQ

SEQ ID NO: 28059 - protein, 6 aa, Brucella spp.
QNAQSY

SEQ ID NO: 28060 - protein, 6 aa, Brucella spp.
RDNEAR

SEQ ID NO: 28061 - protein, 10 aa, Brucella spp.
EKGRGGAQNH

SEQ ID NO: 28062 - protein, 20 aa, Brucella spp.
MRGNGGVFGQGGGYQSPGMQ

SEQ ID NO: 28063 - protein, 6 aa, Brucella spp.
GKVEDV

SEQ ID NO: 28064 - protein, 10 aa, Brucella spp.
QLQKTQEDNE

SEQ ID NO: 28065 - protein, 25 aa, Brucella spp.
KKGLTPPQAQRTSQPAQPAPAPGAD

SEQ ID NO: 28066 - protein, 4 aa, Brucella spp.
SARA

SEQ ID NO: 28067 - protein, 9 aa, Brucella spp.
KMQEENERR

SEQ ID NO: 28068 - protein, 53 aa, Brucella spp.
ESGGRADAGGSSRDTSLADAGAAGSLDGGVSGSAGSQAMASSSSQQSAADSVA

SEQ ID NO: 28069 - protein, 18 aa, Brucella spp.
GSAASQGGPARGEPPQTL

SEQ ID NO: 28070 - protein, 37 aa, Brucella spp.
NATPQPVQQGGGGIQTGGAANDAVASLPTDDNPNSLY

SEQ ID NO: 28071 - protein, 8 aa, Brucella spp.
YKAAEAGF

SEQ ID NO: 28072 - protein, 8 aa, Brucella spp.
YPADPMTA

SEQ ID NO: 28073 - protein, 8 aa, Brucella spp.
GQGRYPEA

SEQ ID NO: 28074 - protein, 12 aa, Brucella spp.
RDYPDSKRAPEN

SEQ ID NO: 28075 - protein, 9 aa, Brucella spp.
QRYPKAAPA

SEQ ID NO: 28076 - protein, 6 aa, Brucella spp.
VSAARP

SEQ ID NO: 28077 - protein, 11 aa, Brucella spp.
LPGEAEGASIG

SEQ ID NO: 28078 - protein, 20 aa, Brucella spp.
RQSSGNAERDAAAQEAARRI

SEQ ID NO: 28079 - protein, 8 aa, Brucella spp.
KSLDGSEF

SEQ ID NO: 28080 - protein, 5 aa, Brucella spp.
ASQTG

SEQ ID NO: 28081 - protein, 13 aa, Brucella spp.
ATSGTKTKQEPTG

SEQ ID NO: 28082 - protein, 5 aa, Brucella spp.
LGGYS

SEQ ID NO: 28083 - protein, 17 aa, Brucella spp.
GRNPLAGKLPGRSNTWN

SEQ ID NO: 28084 - protein, 8 aa, Brucella spp.
GGAQLGES

SEQ ID NO: 28085 - protein, 9 aa, Brucella spp.
DISRDDDRG

SEQ ID NO: 28086 - protein, 6 aa, Brucella spp.
PENRKN

SEQ ID NO: 28087 - protein, 5 aa, Brucella spp.
RQAYT

SEQ ID NO: 28088 - protein, 11 aa, Brucella spp.
RGSTSAGERGG

SEQ ID NO: 28089 - protein, 9 aa, Brucella spp.
VESLESDTT

SEQ ID NO: 28090 - protein, 12 aa, Brucella spp.
NSKTQFSTPSGR

SEQ ID NO: 28091 - protein, 4 aa, Brucella spp.
LNTV

SEQ ID NO: 28092 - protein, 4 aa, Brucella spp.
PGED

SEQ ID NO: 28093 - protein, 10 aa, Brucella spp.
GDDPNSSRYE

SEQ ID NO: 28094 - protein, 8 aa, Brucella spp.
ITTNSNLE

SEQ ID NO: 28095 - protein, 12 aa, Brucella spp.
NNLGSNPALSTL

SEQ ID NO: 28096 - protein, 5 aa, Brucella spp.
HDLGQ

SEQ ID NO: 28097 - protein, 4 aa, Brucella spp.
IPGT

SEQ ID NO: 28098 - protein, 7 aa, Brucella spp.
FSAGAQE

SEQ ID NO: 28099 - protein, 5 aa, Brucella spp.
TKETG

SEQ ID NO: 28100 - protein, 5 aa, Brucella spp.
AGGSG

SEQ ID NO: 28101 - protein, 5 aa, Brucella spp.
DKLPN

SEQ ID NO: 28102 - protein, 11 aa, Brucella spp.
RAATYDPGNEY

SEQ ID NO: 28103 - protein, 10 aa, Brucella spp.
IKEALGTDTI

SEQ ID NO: 28104 - protein, 7 aa, Brucella spp.
PEKTAKL

SEQ ID NO: 28105 - protein, 13 aa, Brucella spp.
DPNSPSPDDLQKA

SEQ ID NO: 28106 - protein, 12 aa, Brucella spp.
RDRAEKAKQGVE

SEQ ID NO: 28107 - protein, 4 aa, Brucella spp.
AAKA

SEQ ID NO: 28108 - protein, 8 aa, Brucella spp.
GNKASQKF

SEQ ID NO: 28109 - protein, 7 aa, Brucella spp.
PEIYPSD

SEQ ID NO: 28110 - protein, 9 aa, Brucella spp.
TPYDTKTQR

SEQ ID NO: 28111 - protein, 10 aa, Brucella spp.
LTDQGQKPLM

SEQ ID NO: 28112 - protein, 9 aa, Brucella spp.
ANSNGRLGT

SEQ ID NO: 28113 - protein, 18 aa, Brucella spp.
QSGAKKNALAAGQASQPF

SEQ ID NO: 28114 - protein, 16 aa, Brucella spp.
RAGSEPNVPHDKQITD

SEQ ID NO: 28115 - protein, 21 aa, Brucella spp.
WPRTSSAATLKGSAKWRGEAT

SEQ ID NO: 28116 - protein, 13 aa, Brucella spp.
GGTSDLTASLTAN

SEQ ID NO: 28117 - protein, 6 aa, Brucella spp.
KANISR

SEQ ID NO: 28118 - protein, 8 aa, Brucella spp.
AKTPSLSG

SEQ ID NO: 28119 - protein, 7 aa, Brucella spp.
IAGSSEI

SEQ ID NO: 28120 - protein, 6 aa, Brucella spp.
ITATPK

SEQ ID NO: 28121 - protein, 9 aa, Brucella spp.
TANGSPAKG

SEQ ID NO: 28122 - protein, 8 aa, Brucella spp.
QEQPAVTG

SEQ ID NO: 28123 - protein, 16 aa, Brucella spp.
DSAARSPSERNNPNRD

SEQ ID NO: 28124 - protein, 10 aa, Brucella spp.
AQSATAGPVT

SEQ ID NO: 28125 - protein, 7 aa, Brucella spp.
KSASGEL

SEQ ID NO: 28126 - protein, 6 aa, Brucella spp.
SDINSS

SEQ ID NO: 28127 - protein, 4 aa, Brucella spp.
ISGK

SEQ ID NO: 28128 - protein, 4 aa, Brucella spp.
AQGN

SEQ ID NO: 28129 - protein, 8 aa, Brucella spp.
NLSDGVAT

SEQ ID NO: 28130 - protein, 9 aa, Brucella spp.
KLDTSDGTL

SEQ ID NO: 28131 - protein, 25 aa, Brucella spp.
NSQPQQPESDTDGEQPAETPPAKPP

SEQ ID NO: 28132 - protein, 12 aa, Brucella spp.
REARAENTYTAE

SEQ ID NO: 28133 - protein, 9 aa, Brucella spp.
STSGGIASA

SEQ ID NO: 28134 - protein, 6 aa, Brucella spp.
EEGSGA

SEQ ID NO: 28135 - protein, 5 aa, Brucella spp.
GEGTL

SEQ ID NO: 28136 - protein, 8 aa, Brucella spp.
TKNAGDHK

SEQ ID NO: 28137 - protein, 5 aa, Brucella spp.
GGQGS

SEQ ID NO: 28138 - protein, 7 aa, Brucella spp.
AEPASCS

SEQ ID NO: 28139 - protein, 6 aa, Brucella spp.
TSTTAV

SEQ ID NO: 28140 - protein, 4 aa, Brucella spp.
DKLG

SEQ ID NO: 28141 - protein, 8 aa, Brucella spp.
IEPGNDGN

SEQ ID NO: 28142 - protein, 8 aa, Brucella spp.
AESSEQGM

SEQ ID NO: 28143 - protein, 6 aa, Brucella spp.
SIKSKE

SEQ ID NO: 28144 - protein, 17 aa, Brucella spp.
GAKVETNVRTGYTQECP

SEQ ID NO: 28145 - protein, 11 aa, Brucella spp.
DDGEEPAKAAT

SEQ ID NO: 28146 - protein, 17 aa, Brucella spp.
TVDGKEGLPAVRSALGL

SEQ ID NO: 28147 - protein, 4 aa, Brucella spp.
APAA

SEQ ID NO: 28148 - protein, 7 aa, Brucella spp.
AQPATEI

SEQ ID NO: 28149 - protein, 8 aa, Brucella spp.
NSGYVDGV

SEQ ID NO: 28150 - protein, 14 aa, Brucella spp.
AGSDLNYSKSITPE

SEQ ID NO: 28151 - protein, 11 aa, Brucella spp.
NINGAGSLDGF

SEQ ID NO: 28152 - protein, 5 aa, Brucella spp.
DAGSV

SEQ ID NO: 28153 - protein, 13 aa, Brucella spp.
TLAGGAEVSGKAK

SEQ ID NO: 28154 - protein, 23 aa, Brucella spp.
KGMPRTSPILVRIFKEEGVLEVW

SEQ ID NO: 28155 - protein, 24 aa, Brucella spp.
VRIFKEEGVLEVWKQKNNGKYDQI

SEQ ID NO: 28156 - protein, 17 aa, Brucella spp.
YDQIASYEICKWSGKLG

SEQ ID NO: 28157 - protein, 18 aa, Brucella spp.
ASYEICKWSGKLGPKYIE

SEQ ID NO: 28158 - protein, 24 aa, Brucella spp.
PHSNYYLAFNIGFPNAYDRANGRT

SEQ ID NO: 28159 - protein, 19 aa, Brucella spp.
TDEQVAEIYAFGRDAFKGG

SEQ ID NO: 28160 - protein, 19 aa, Brucella spp.
VAEIYAFGRDAFKGGQREF

SEQ ID NO: 28161 - protein, 19 aa, Brucella spp.
QIQAFPFRMTAANMTRYKN

SEQ ID NO: 28162 - protein, 18 aa, Brucella spp.
NDPNYSFWKMLKQGYDAF

SEQ ID NO: 28163 - protein, 20 aa, Brucella spp.
VDVCEKRYVFNVPTPDGQPL

SEQ ID NO: 28164 - protein, 19 aa, Brucella spp.
AEAKLVSAWSAARARGEKV

SEQ ID NO: 28165 - protein, 22 aa, Brucella spp.
FYIERPGKIRFNYNNSPIRVIS

SEQ ID NO: 28166 - protein, 24 aa, Brucella spp.
QPELPENMHFIPGHPLAGTEYSGP

SEQ ID NO: 28167 - protein, 25 aa, Brucella spp.
DAGFAELFTNRWCILTPLPDTDEKA

SEQ ID NO: 28168 - protein, 19 aa, Brucella spp.
DEKALEKLTAFWTACGSRL

SEQ ID NO: 28169 - protein, 23 aa, Brucella spp.
IVSHLPHIIAYNIVGTASDLELV

SEQ ID NO: 28170 - protein, 22 aa, Brucella spp.
VIKYSASGFRDFTRLAASDPTM

SEQ ID NO: 28171 - protein, 18 aa, Brucella spp.
HNKDAILEMLGRFSEDLA

SEQ ID NO: 28172 - protein, 18 aa, Brucella spp.
ILEMLGRFSEDLASLQRS

SEQ ID NO: 28173 - protein, 17 aa, Brucella spp.
LQRSIRWGDGEALFDLF

SEQ ID NO: 28174 - protein, 23 aa, Brucella spp.
RWGDGEALFDLFTRTRAVHRGII

SEQ ID NO: 28175 - protein, 25 aa, Brucella spp.
MAAEHELTGLLSFDYGQRHKKELDF

SEQ ID NO: 28176 - protein, 25 aa, Brucella spp.
VVPNRNAIMLAIAFGVAAAQKADAV

SEQ ID NO: 28177 - protein, 19 aa, Brucella spp.
EGKQLAGLWEFPGGKVEPG

SEQ ID NO: 28178 - protein, 23 aa, Brucella spp.
TTKIPCLAPLTFASYTYDDFHLL

SEQ ID NO: 28179 - protein, 19 aa, Brucella spp.
FHLLMPLYVCRRFEGVARG

SEQ ID NO: 28180 - protein, 23 aa, Brucella spp.
AGLKELGDVVLFDIAEGTPQGKG

SEQ ID NO: 28181 - protein, 17 aa, Brucella spp.
RDDLLGINLKVMEQVGA

SEQ ID NO: 28182 - protein, 19 aa, Brucella spp.
TNPLDAMVWALQKFSGLPA

SEQ ID NO: 28183 - protein, 20 aa, Brucella spp.
GVLDSARFRYFLSEEFNVSV

SEQ ID NO: 28184 - protein, 17 aa, Brucella spp.
VEDVTAFVLGGHGDSMV

SEQ ID NO: 28185 - protein, 26 aa, Brucella spp.
NDKPGFKLNGIVIWPEEGVARPYALI

SEQ ID NO: 28186 - protein, 20 aa, Brucella spp.
EEGVARPYALITYNCKGDGS

SEQ ID NO: 28187 - protein, 25 aa, Brucella spp.
KIEKDGVEPSYLFGTLHLSDPRVMK

SEQ ID NO: 28188 - protein, 18 aa, Brucella spp.
MNKIKPWVLSNLLATTKC

SEQ ID NO: 28189 - protein, 25 aa, Brucella spp.
AMNSLPLDFHIRNLIATVDFGDKIE

SEQ ID NO: 28190 - protein, 17 aa, Brucella spp.
TAITLYLQGDVGMIAPA

SEQ ID NO: 28191 - protein, 19 aa, Brucella spp.
RYLGDITLADGIRASTDAA

SEQ ID NO: 28192 - protein, 26 aa, Brucella spp.
VAEILPDHRIAALSGPSFASDVARGL

SEQ ID NO: 28193 - protein, 19 aa, Brucella spp.
RLAALLSGPAFRCYSTTDL

SEQ ID NO: 28194 - protein, 18 aa, Brucella spp.
FAELRRIGQAMSARPETI

SEQ ID NO: 28195 - protein, 23 aa, Brucella spp.
MSARPETIMGLSGLGDLMLTCSS

SEQ ID NO: 28196 - protein, 17 aa, Brucella spp.
AELCRKHNISAPIIDAV

SEQ ID NO: 28197 - protein, 25 aa, Brucella spp.
SDVYKELALFGDIFERVRAQYVTPP

SEQ ID NO: 28198 - protein, 22 aa, Brucella spp.
RGEVGAPIELTILRKGADKPIT

SEQ ID NO: 28199 - protein, 19 aa, Brucella spp.
ADKPITLKINRAIIKVKAV

SEQ ID NO: 28200 - protein, 23 aa, Brucella spp.
VENDVGYLRIISFTEQTSEDLKK

SEQ ID NO: 28201 - protein, 25 aa, Brucella spp.
ADKLKGYVLDLRLNPGGLLDQAVAV

SEQ ID NO: 28202 - protein, 17 aa, Brucella spp.
LNPGGLLDQAVAVSDAF

SEQ ID NO: 28203 - protein, 17 aa, Brucella spp.
ENGSLRLTTALYYTPSG

SEQ ID NO: 28204 - protein, 20 aa, Brucella spp.
KLLRGEVANAAFPPDPKKGV

SEQ ID NO: 28205 - protein, 25 aa, Brucella spp.
SFSFRRIFIALGLTVLVPLLSACGF

SEQ ID NO: 28206 - protein, 17 aa, Brucella spp.
TVLVPLLSACGFNTIPT

SEQ ID NO: 28207 - protein, 27 aa, Brucella spp.
SLRTMPTMIWTWIWYRDAQPMPTFSAD

SEQ ID NO: 28208 - protein, 19 aa, Brucella spp.
REEERALAIRWKETKDQDA

SEQ ID NO: 28209 - protein, 25 aa, Brucella spp.
SAHMRLVISMAGRFRKFKLPMSDLI

SEQ ID NO: 28210 - protein, 19 aa, Brucella spp.
RFRKFKLPMSDLIQEGYVG

SEQ ID NO: 28211 - protein, 19 aa, Brucella spp.
FKLPMSDLIQEGYVGLLEE

SEQ ID NO: 28212 - protein, 23 aa, Brucella spp.
RDVRFSTYASWWIRASMQDYILR

SEQ ID NO: 28213 - protein, 18 aa, Brucella spp.
DYILRNWSIVRGGTSSAQ

SEQ ID NO: 28214 - protein, 18 aa, Brucella spp.
AMEKLKIALLSQHELAAY

SEQ ID NO: 28215 - protein, 27 aa, Brucella spp.
SPNINAFALPGGYLYITRGLLALANDS

SEQ ID NO: 28216 - protein, 17 aa, Brucella spp.
AAIARRVATEVLHNKAA

SEQ ID NO: 28217 - protein, 23 aa, Brucella spp.
EAEIRGKLRLAQFSRNQELQADA

SEQ ID NO: 28218 - protein, 17 aa, Brucella spp.
LAHARRIGAPGVGTTDR

SEQ ID NO: 28219 - protein, 23 aa, Brucella spp.
NFIHPKLGVTFRAPDGFTIDNSA

SEQ ID NO: 28220 - protein, 18 aa, Brucella spp.
GEVAIRFDGASLPSASSL

SEQ ID NO: 28221 - protein, 19 aa, Brucella spp.
SADRWQFDIVVIGANNKVY

SEQ ID NO: 28222 - protein, 22 aa, Brucella spp.
AEQSAIKPLRIRVVTVKPGDTM

SEQ ID NO: 28223 - protein, 25 aa, Brucella spp.
QGATRKLELFRLLNAMPAGATVSVG

SEQ ID NO: 28224 - protein, 20 aa, Brucella spp.
DIFVPYDYGYFAVVYDSEKL

SEQ ID NO: 28225 - protein, 24 aa, Brucella spp.
RTATPGLGMLLWMKSVYGDEAGAA

SEQ ID NO: 28226 - protein, 18 aa, Brucella spp.
VAKNRRLWVNEWLAATSR

SEQ ID NO: 28227 - protein, 25 aa, Brucella spp.
LAVVSFSSPKAFDVQDSESFPVDIV

SEQ ID NO: 28228 - protein, 28 aa, Brucella spp.
VQDSESFPVDIVPIESLTQIQQGDKKAP

SEQ ID NO: 28229 - protein, 21 aa, Brucella spp.
APDAEALKLPDRVPAPKAKPK

SEQ ID NO: 28230 - protein, 17 aa, Brucella spp.
LKLPDRVPAPKAKPKPP

SEQ ID NO: 28231 - protein, 26 aa, Brucella spp.
SEMDALRGAISKCWNVPAGVADAPGL

SEQ ID NO: 28232 - protein, 19 aa, Brucella spp.
WNVPAGVADAPGLVVTVKM

SEQ ID NO: 28233 - protein, 19 aa, Brucella spp.
VVTVKMKLAEDGSIQGTPE

SEQ ID NO: 28234 - protein, 27 aa, Brucella spp.
RRAVMRCAPYNLPVDKYDSWSEVIVNF

SEQ ID NO: 28235 - protein, 19 aa, Brucella spp.
VDKYDSWSEVIVNFDPSEM

SEQ ID NO: 28236 - protein, 18 aa, Brucella spp.
ARAVVEININKGVIEPLP

SEQ ID NO: 28237 - protein, 19 aa, Brucella spp.
VIEPLPIAITDFLSADQLG

SEQ ID NO: 28238 - protein, 19 aa, Brucella spp.
PIAITDFLSADQLGSNITS

SEQ ID NO: 28239 - protein, 18 aa, Brucella spp.
AADLERSGLFAPIDTGAF

SEQ ID NO: 28240 - protein, 19 aa, Brucella spp.
RSGLFAPIDTGAFIEKISN

SEQ ID NO: 28241 - protein, 25 aa, Brucella spp.
NPDAAPRFEDWKVINAQALVTGRIT

SEQ ID NO: 28242 - protein, 18 aa, Brucella spp.
VINAQALVTGRITKQPDG

SEQ ID NO: 28243 - protein, 23 aa, Brucella spp.
GRLKAEFRLWDTFGGQQMIGQQF

SEQ ID NO: 28244 - protein, 19 aa, Brucella spp.
VGNFPGMTIAPRFSPDGQK

SEQ ID NO: 28245 - protein, 17 aa, Brucella spp.
MTIAPRFSPDGQKVVMS

SEQ ID NO: 28246 - protein, 24 aa, Brucella spp.
TWAPNGRVLMFFRKAAGAGGPKLF

SEQ ID NO: 28247 - protein, 22 aa, Brucella spp.
RSPIAIALFMSLAVAGCASKKN

SEQ ID NO: 28248 - protein, 20 aa, Brucella spp.
QGMGNPVAIADALSARAEAM

SEQ ID NO: 28249 - protein, 23 aa, Brucella spp.
SARAEAMNFQILEMQDQMQKMQE

SEQ ID NO: 28250 - protein, 23 aa, Brucella spp.
RGEPPQTLGSIRFDTNGNVIGET

SEQ ID NO: 28251 - protein, 17 aa, Brucella spp.
PADPMTAEARFWLGESL

SEQ ID NO: 28252 - protein, 26 aa, Brucella spp.
PMTAEARFWLGESLYGQGRYPEAATL

SEQ ID NO: 28253 - protein, 25 aa, Brucella spp.
YGQGRYPEAATLFIDTQRDYPDSKR

SEQ ID NO: 28254 - protein, 24 aa, Brucella spp.
RAPENMFKLGMALEKMDNHDVACA

SEQ ID NO: 28255 - protein, 25 aa, Brucella spp.
HDVACATFAQIPQRYPKAAPAILKR

SEQ ID NO: 28256 - protein, 22 aa, Brucella spp.
QRYPKAAPAILKRVADERSRAK

SEQ ID NO: 28257 - protein, 19 aa, Brucella spp.
QALLIAALPLLVFCGPPQA

SEQ ID NO: 28258 - protein, 19 aa, Brucella spp.
NLYGFGAVTGMFSWTLGQD

SEQ ID NO: 28259 - protein, 19 aa, Brucella spp.
YTLNDGFLVNAVRGSTSAG

SEQ ID NO: 28260 - protein, 24 aa, Brucella spp.
VSGHLKWTSAFEMPGLWLEGELAH

SEQ ID NO: 28261 - protein, 24 aa, Brucella spp.
FHPGEDVSAWAYYGTVGYLMKEIG

SEQ ID NO: 28262 - protein, 25 aa, Brucella spp.
YLMKEIGWTPSLSYRYAYFSGDDPN

SEQ ID NO: 28263 - protein, 20 aa, Brucella spp.
FDPLLSTGLGIWLQGVSFGK

SEQ ID NO: 28264 - protein, 23 aa, Brucella spp.
LGQELSLSARWSATKSLYLQALV

SEQ ID NO: 28265 - protein, 18 aa, Brucella spp.
GTALRDIGADRNWTTFQV

SEQ ID NO: 28266 - protein, 17 aa, Brucella spp.
LETKLLAGGSGYDLVVP

SEQ ID NO: 28267 - protein, 18 aa, Brucella spp.
GRQIPAGVFLKLDKDKLP

SEQ ID NO: 28268 - protein, 17 aa, Brucella spp.
IPAGVFLKLDKDKLPNL

SEQ ID NO: 28269 - protein, 23 aa, Brucella spp.
PGNEYSVNYMWGTTGIGYNKAKI

SEQ ID NO: 28270 - protein, 20 aa, Brucella spp.
EMLRPALNYLGLDPNSPSPD

SEQ ID NO: 28271 - protein, 26 aa, Brucella spp.
IGYSIPKEGALIWFDQMAIPADAKHV

SEQ ID NO: 28272 - protein, 18 aa, Brucella spp.
HVPEALEFMNYMMRPEVA

SEQ ID NO: 28273 - protein, 17 aa, Brucella spp.
LIIAFVILCAAAAATLL

SEQ ID NO: 28274 - protein, 19 aa, Brucella spp.
AAAAATLLAVVPFIVSTDA

SEQ ID NO: 28275 - protein, 24 aa, Brucella spp.
RIRVAQEISAWTGYSVELRQAPRL

SEQ ID NO: 28276 - protein, 26 aa, Brucella spp.
ELRQAPRLSVFPVLRASLSGVTLSKL

SEQ ID NO: 28277 - protein, 17 aa, Brucella spp.
IDVELSPLDAIMGHISF

SEQ ID NO: 28278 - protein, 20 aa, Brucella spp.
ELSPLDAIMGHISFSETQIV

SEQ ID NO: 28279 - protein, 19 aa, Brucella spp.
NATLEWPRTSSAATLKGSA

SEQ ID NO: 28280 - protein, 18 aa, Brucella spp.
ATQFSLTVAQALPLLAGG

SEQ ID NO: 28281 - protein, 19 aa, Brucella spp.
LSGAVRWLNLPPIAGSSEI

SEQ ID NO: 28282 - protein, 25 aa, Brucella spp.
LAFEKLDLSRLFSAFIPLPDSAARS

SEQ ID NO: 28283 - protein, 24 aa, Brucella spp.
GRAIFDIGDAKAFNGILQANVQIV

SEQ ID NO: 28284 - protein, 19 aa, Brucella spp.
INSSQFFAALGFDKPFISG

SEQ ID NO: 28285 - protein, 25 aa, Brucella spp.
FFALERKDNIALAFNRLDVKANLSD

SEQ ID NO: 28286 - protein, 22 aa, Brucella spp.
GTLTLAGIVPFVDRSLALSGEV

SEQ ID NO: 28287 - protein, 24 aa, Brucella spp.
PAKPPLHFFVGGSWDRPFISPSSM

SEQ ID NO: 28288 - protein, 25 aa, Brucella spp.
IRFRNAACFVAFFAALFVSFIALPR

SEQ ID NO: 28289 - protein, 17 aa, Brucella spp.
PSLGWDFGGQGSRVMML

SEQ ID NO: 28290 - protein, 24 aa, Brucella spp.
VLKRENIVLVPIRTGIGARLGVNI

SEQ ID NO: 28291 - protein, 23 aa, Brucella spp.
LAKKDIDVFLGYWNPSMSADLQP

SEQ ID NO: 28292 - protein, 26 aa, Brucella spp.
RSIKSKEPIVFLAWEPHPMNKRFKIA

SEQ ID NO: 28293 - protein, 21 aa, Brucella spp.
MNKRFKIAYLTGGDDFFGPNL

SEQ ID NO: 28294 - protein, 20 aa, Brucella spp.
ECPNVGKFLTNLEFNLDMEN

SEQ ID NO: 28295 - protein, 21 aa, Brucella spp.
EALSPWQIRVRALGVIAENSG

SEQ ID NO: 28296 - protein, 17 aa, Brucella spp.
ITPELDITYYFTKNIAA

SEQ ID NO: 28297 - protein, 20 aa, Brucella spp.
PELDITYYFTKNIAAELILG

SEQ ID NO: 28298 - protein, 19 aa, Brucella spp.
LTLQYHFTNFGAFKPYVGA

SEQ ID NO: 28299 - protein, 18 aa, Brucella spp.
KNTFGGALQIGFDYMLNE

SEQ ID NO: 28300 - protein, 23 aa, Brucella spp.
LRTMPTMIWTWIWYRDAQPMPTF

SEQ ID NO: 28301 - protein, 22 aa, Brucella spp.
AAEHELTGLLSFDYGQRHKKEL

SEQ ID NO: 28302 - protein, 22 aa, Brucella spp.
IKSKEPIVFLAWEPHPMNKRFK

SEQ ID NO: 28303 - protein, 21 aa, Brucella spp.
PNRNAIMLAIAFGVAAAQKAD

SEQ ID NO: 28304 - protein, 20 aa, Brucella spp.
ATRKLELFRLLNAMPAGATV

SEQ ID NO: 28305 - protein, 20 aa, Brucella spp.
RSPIAIALFMSLAVAGCASK

SEQ ID NO: 28306 - protein, 19 aa, Brucella spp.
KEGALIWFDQMAIPADAKH

SEQ ID NO: 28307 - protein, 18 aa, Brucella spp.
KELALFGDIFERVRAQYV

SEQ ID NO: 28308 - protein, 18 aa, Brucella spp.
EIRGKLRLAQFSRNQELQ

SEQ ID NO: 28309 - protein, 18 aa, Brucella spp.
IGWTPSLSYRYAYFSGDD

SEQ ID NO: 28310 - protein, 18 aa, Brucella spp.
RKDNIALAFNRLDVKANL

SEQ ID NO: 28311 - protein, 17 aa, Brucella spp.
NDVGYLRIISFTEQTSE

SEQ ID NO: 28312 - protein, 17 aa, Brucella spp.
YVLDLRLNPGGLLDQAV

SEQ ID NO: 28313 - protein, 17 aa, Brucella spp.
PYNLPVDKYDSWSEVIV

SEQ ID NO: 28314 - protein, 17 aa, Brucella spp.
LDLSRLFSAFIPLPDSA

SEQ ID NO: 28315 - protein, 24 aa, Brucella spp.
RTSPILVRIFKEEGVLEVWKQKNN

SEQ ID NO: 28316 - protein, 28 aa, Brucella spp.
QMNPHSNYYLAFNIGFPNAYDRANGRTG

SEQ ID NO: 28317 - protein, 28 aa, Brucella spp.
GGQREFQIQAFPFRMTAANMTRYKNDPN

SEQ ID NO: 28318 - protein, 26 aa, Brucella spp.
KNDPNYSFWKMLKQGYDAFETTKVPP

SEQ ID NO: 28319 - protein, 18 aa, Brucella spp.
VCEKRYVFNVPTPDGQPL

SEQ ID NO: 28320 - protein, 28 aa, Brucella spp.
NNRKLDTWDLYPLSKTPLKLLLADRIDL

SEQ ID NO: 28321 - protein, 25 aa, Brucella spp.
LKQRTTMVLLREDPKLVVNIDAHNL

SEQ ID NO: 28322 - protein, 20 aa, Brucella spp.
PELPENMHFIPGHPLAGTEY

SEQ ID NO: 28323 - protein, 29 aa, Brucella spp.
AGFAELFTNRWCILTPLPDTDEKALEKLT

SEQ ID NO: 28324 - protein, 25 aa, Brucella spp.
DPQHHDLVLAIVSHLPHIIAYNIVG

SEQ ID NO: 28325 - protein, 25 aa, Brucella spp.
VPNRNAIMLAIAFGVAAAQKADAVA

SEQ ID NO: 28326 - protein, 27 aa, Brucella spp.
AVHGGDHFIYPDCRPGFIEAFQTMQKH

SEQ ID NO: 28327 - protein, 17 aa, Brucella spp.
TTKIPCLAPLTFASYTY

SEQ ID NO: 28328 - protein, 18 aa, Brucella spp.
PCLAPLTFASYTYDDFHL

SEQ ID NO: 28329 - protein, 27 aa, Brucella spp.
ASYTYDDFHLLMPLYVCRRFEGVARGL

SEQ ID NO: 28330 - protein, 37 aa, Brucella spp.
KYAPEAFVICITNPLDAMVWALQKFSGLPAHKVVGMA

SEQ ID NO: 28331 - protein, 26 aa, Brucella spp.
GVLDSARFRYFLSEEFNVSVEDVTAF

SEQ ID NO: 28332 - protein, 18 aa, Brucella spp.
NVTVMSALALTVFSTAVQ

SEQ ID NO: 28333 - protein, 24 aa, Brucella spp.
FKLNGIVIWPEEGVARPYALITYN

SEQ ID NO: 28334 - protein, 25 aa, Brucella spp.
PAAQAVLFPDLVTALDGYDFGAAKP

SEQ ID NO: 28335 - protein, 18 aa, Brucella spp.
ICVAFLAPAAARAGQAPC

SEQ ID NO: 28336 - protein, 17 aa, Brucella spp.
RKTFPRIMQEQPDLMLF

SEQ ID NO: 28337 - protein, 18 aa, Brucella spp.
PRIMQEQPDLMLFNDGTT

SEQ ID NO: 28338 - protein, 25 aa, Brucella spp.
MNSLPLDFHIRNLIATVDFGDKIED

SEQ ID NO: 28339 - protein, 23 aa, Brucella spp.
KDRRNPRYLGDITLADGIRASTD

SEQ ID NO: 28340 - protein, 24 aa, Brucella spp.
GLSELGTLIPQASPIVLCAKGIEQ

SEQ ID NO: 28341 - protein, 22 aa, Brucella spp.
VAEILPDHRIAALSGPSFASDV

SEQ ID NO: 28342 - protein, 18 aa, Brucella spp.
TADRLAALLSGPAFRCYS

SEQ ID NO: 28343 - protein, 24 aa, Brucella spp.
SARPETIMGLSGLGDLMLTCSSSQ

SEQ ID NO: 28344 - protein, 17 aa, Brucella spp.
FAGALLGASAMVMVQGA

SEQ ID NO: 28345 - protein, 30 aa, Brucella spp.
DSDVYKELALFGDIFERVRAQYVTPPDDKK

SEQ ID NO: 28346 - protein, 25 aa, Brucella spp.
DKLKGYVLDLRLNPGGLLDQAVAVS

SEQ ID NO: 28347 - protein, 17 aa, Brucella spp.
SVQTIIPLGENGSLRLT

SEQ ID NO: 28348 - protein, 17 aa, Brucella spp.
IPLGENGSLRLTTALYY

SEQ ID NO: 28349 - protein, 24 aa, Brucella spp.
SFSFRRIFIALGLTVLVPLLSACG

SEQ ID NO: 28350 - protein, 32 aa, Brucella spp.
NTSLRTMPTMIWTWIWYRDAQPMPTFSADAGS

SEQ ID NO: 28351 - protein, 25 aa, Brucella spp.
ITSAHMRLVISMAGRFRKFKLPMSD

SEQ ID NO: 28352 - protein, 35 aa, Brucella spp.
VRFSTYASWWIRASMQDYILRNWSIVRGGTSSAQK

SEQ ID NO: 28353 - protein, 27 aa, Brucella spp.
TSSAQKVLFFNLRRLRSKLAQTDDNMT

SEQ ID NO: 28354 - protein, 43 aa, Brucella spp.
PDQTYRITILDSPNINAFALPGGYLYITRGLLALANDSSEVAA

SEQ ID NO: 28355 - protein, 24 aa, Brucella spp.
YVREQNFIHPKLGVTFRAPDGFTI

SEQ ID NO: 28356 - protein, 25 aa, Brucella spp.
ASADRWQFDIVVIGANNKVYRFLTA

SEQ ID NO: 28357 - protein, 27 aa, Brucella spp.
QGATRKLELFRLLNAMPAGATVSVGDR

SEQ ID NO: 28358 - protein, 26 aa, Brucella spp.
GNFKDDIFVPYDYGYFAVVYDSEKLP

SEQ ID NO: 28359 - protein, 24 aa, Brucella spp.
ATPGLGMLLWMKSVYGDEAGAAWQ

SEQ ID NO: 28360 - protein, 21 aa, Brucella spp.
VVLHAVAVALAVVSFSSPKAF

SEQ ID NO: 28361 - protein, 27 aa, Brucella spp.
QDSESFPVDIVPIESLTQIQQGDKKAP

SEQ ID NO: 28362 - protein, 17 aa, Brucella spp.
GAISKCWNVPAGVADAP

SEQ ID NO: 28363 - protein, 18 aa, Brucella spp.
KCWNVPAGVADAPGLVVT

SEQ ID NO: 28364 - protein, 28 aa, Brucella spp.
ESARRAVMRCAPYNLPVDKYDSWSEVIV

SEQ ID NO: 28365 - protein, 25 aa, Brucella spp.
NINKGVIEPLPIAITDFLSADQLGS

SEQ ID NO: 28366 - protein, 26 aa, Brucella spp.
GRLKAEFRLWDTFGGQQMIGQQFFTT

SEQ ID NO: 28367 - protein, 19 aa, Brucella spp.
DNWRRVAHIIADAIYERLT

SEQ ID NO: 28368 - protein, 26 aa, Brucella spp.
WAPNGRVLMFFRKAAGAGGPKLFTID

SEQ ID NO: 28369 - protein, 19 aa, Brucella spp.
RSPIAIALFMSLAVAGCAS

SEQ ID NO: 28370 - protein, 26 aa, Brucella spp.
TVNVGDRIFFDLDSSLIRADAQQTLS

SEQ ID NO: 28371 - protein, 26 aa, Brucella spp.
TLSKQAQWLQRYPQYSITIEGHADER

SEQ ID NO: 28372 - protein, 17 aa, Brucella spp.
PLLASAPVLAASVSSQE

SEQ ID NO: 28373 - protein, 24 aa, Brucella spp.
AQSYSRILQLRDKMLKIQRDNEAR

SEQ ID NO: 28374 - protein, 18 aa, Brucella spp.
SLYQAAYQYLMSGDYKAA

SEQ ID NO: 28375 - protein, 28 aa, Brucella spp.
DPMTAEARFWLGESLYGQGRYPEAATLF

SEQ ID NO: 28376 - protein, 24 aa, Brucella spp.
KRAPENMFKLGMALEKMDNHDVAC

SEQ ID NO: 28377 - protein, 28 aa, Brucella spp.
KQALLIAALPLLVFCGPPQAMAQDVSAA

SEQ ID NO: 28378 - protein, 17 aa, Brucella spp.
RFYLLPSASQTGVKLVF

SEQ ID NO: 28379 - protein, 33 aa, Brucella spp.
SRYERFDPLLSTGLGIWLQGVSFGKITTNSNLE

SEQ ID NO: 28380 - protein, 30 aa, Brucella spp.
APDERLNLTFDYYLLRTPQLNNLGSNPALS

SEQ ID NO: 28381 - protein, 23 aa, Brucella spp.
KAQDLYLKIRPNIRKFHSSEYIN

SEQ ID NO: 28382 - protein, 26 aa, Brucella spp.
IPKEGALIWFDQMAIPADAKHVPEAL

SEQ ID NO: 28383 - protein, 21 aa, Brucella spp.
ALEFMNYMMRPEVAAKASNYV

SEQ ID NO: 28384 - protein, 19 aa, Brucella spp.
EVMKKLFVPTPYDTKTQRV

SEQ ID NO: 28385 - protein, 22 aa, Brucella spp.
LIIAFVILCAAAAATLLAVVPF

SEQ ID NO: 28386 - protein, 22 aa, Brucella spp.
TLLAVVPFIVSTDAIRIRVAQE

SEQ ID NO: 28387 - protein, 27 aa, Brucella spp.
AFEKLDLSRLFSAFIPLPDSAARSPSE

SEQ ID NO: 28388 - protein, 17 aa, Brucella spp.
INSSQFFAALGFDKPFI

SEQ ID NO: 28389 - protein, 17 aa, Brucella spp.
SSQFFAALGFDKPFISG

SEQ ID NO: 28390 - protein, 18 aa, Brucella spp.
QFFAALGFDKPFISGKGN

SEQ ID NO: 28391 - protein, 27 aa, Brucella spp.
TPPAKPPLHFFVGGSWDRPFISPSSMG

SEQ ID NO: 28392 - protein, 29 aa, Brucella spp.
RFRNAACFVAFFAALFVSFIALPREARAE

SEQ ID NO: 28393 - protein, 25 aa, Brucella spp.
GQGSRVMMLVYNLDDIQHLYGRYAG

SEQ ID NO: 28394 - protein, 17 aa, Brucella spp.
FTLALGGFAMGTAMLST

SEQ ID NO: 28395 - protein, 24 aa, Brucella spp.
KDIDVFLGYWNPSMSADLQPYLDN

SEQ ID NO: 28396 - protein, 23 aa, Brucella spp.
NDGNRLILSMINKNAFGLKSFEL

SEQ ID NO: 28397 - protein, 28 aa, Brucella spp.
SIKSKEPIVFLAWEPHPMNKRFKIAYLT

SEQ ID NO: 28398 - protein, 35 aa, Brucella spp.
FGKIGKVWILPPTLTLQYHFTNFGAFKPYVGAGVN

SEQ ID NO: 28399 - protein, 23 aa, Brucella spp.
TAEARFWLGESLYGQGRYPEAAT

SEQ ID NO: 28400 - protein, 23 aa, Brucella spp.
ERLNLTFDYYLLRTPQLNNLGSN

SEQ ID NO: 28401 - protein, 17 aa, Brucella spp.
KEGALIWFDQMAIPADA

SEQ ID NO: 28402 - protein, 17 aa, Brucella spp.
IWFDQMAIPADAKHVPE

SEQ ID NO: 28403 - protein, 17 aa, Brucella spp.
PAKPPLHFFVGGSWDRP

SEQ ID NO: 28404 - protein, 22 aa, Brucella spp.
IGKVWILPPTLTLQYHFTNFGA

SEQ ID NO: 28405 - protein, 5 aa, Streptococcus pyogenes
QKSKQ

SEQ ID NO: 28406 - protein, 64 aa, Staphylococcus aureus
KDVVNRNQATDPHPTGSSLKPFLAYGPAIENMKWATNHAIQDESSYQVDGSTFRNYDTKSHGTV

SEQ ID NO: 28407 - protein, 68 aa, Staphylococcus aureus
GLGTENGHGNYDVIEEIEENSHVDIKSELGYEGGQNSGNQSFEEDTEEDKPKYEQGGNIVDIDFDSVP

SEQ ID NO: 28408 - protein, 51 aa, Staphylococcus aureus
VVLSPILLITALLIKMESPGPAIFKQKRPTINNELFNIYKFRSMKIDTPNV

SEQ ID NO: 28409 - protein, 48 aa, Staphylococcus aureus
TTETDENGKYRFDNLDSGKYKVIFEKPAGLTQTGTNTTEDDKDADGGE

SEQ ID NO: 28410 - protein, 55 aa, Staphylococcus aureus
DGETTPITKTATYKVVRTVPKHVFETARGVLYPGVSDMYDAKQYVKPVNNSWSTN

SEQ ID NO: 28411 - protein, 14 aa, Homo sapiens
RSILPYGDSMDRIE

SEQ ID NO: 28412 - protein, 50 aa, Artificial Sequence
  Synthetic
MYGIEYTTVLTFLISIILLNYILKSLTRIMDFIIYRFLFIIVILSPFLRA

SEQ ID NO: 28413 - protein, 47 aa, Artificial Sequence
  Synthetic
MASLIYRQLLTNSYSVDLHDEIEQIGSEKTQNVTINPSPFAQTRYAP

SEQ ID NO: 28414 - protein, 9 aa, Vaccinia virus
RLYDYFTRV

SEQ ID NO: 28415 - protein, 15 aa, Arachis hypogaea
LNRHDNQNLRVAKIS

SEQ ID NO: 28416 - protein, 9 aa, Homo sapiens
LLGRHSLFH

SEQ ID NO: 28417 - protein, 25 aa, Artificial Sequence
  Synthetic
LPKPPKPVSKMRMATPLLMQALPMG

SEQ ID NO: 28418 - protein, 14 aa, Artificial Sequence
  Synthetic
MRMATPLLMQALPM

SEQ ID NO: 28419 - protein, 9 aa, Brucella melitensis
RYCINSASL

SEQ ID NO: 28420 - DNA, 93 bp, Brucella melitensis
ttccccgacggccccgtggaccgcggcggcctgcgctactgcatcaactccgcctccctgcgcttcgtgcccaaggaccgcatggaggccgag

SEQ ID NO: 28421 - protein, 31 aa, Brucella melitensis
FPDGPVDRGGLRYCINSASLRFVPKDRMEAE

SEQ ID NO: 28422 - DNA, 93 bp, Brucella melitensis
ttccccgacggccctcctcgtccgaccggcaaaagatactgcatcaactcagcatccttgtccttcactcctgcagaccgcatggaggccgag

SEQ ID NO: 28423 - protein, 31 aa, Brucella melitensis
FPDGPPRPTGKRYCINSASLSFTPADRMEAE

3. The process of claim 1, wherein said binding affinity of said variant peptide sequence is increased as compared to the binding affinity of the peptide of interest in the cancer protein.

4. The process of claim 1, wherein said binding affinity of said variant peptide sequence is decreased as compared to the binding affinity of the peptide of interest in the cancer protein.

5. The process of claim 1, wherein said binding affinity of the variant peptide sequence is increased or decreased by >1 standard deviation units.

6. The process of claim 1, wherein said binding affinity of the variant peptide sequence is increased or decreased by >2 standard deviation units.

7. The process of claim 1, wherein from about 10 to about 100 peptide sequences are selected for synthesis.

8. The process of claim 1, wherein at least 2 amino acids of said synthesized peptide sequence are modified.

9. The process of claim 1, wherein from 1,000 to about 5,000 variant peptide sequences are generated in step (e).

10. The process of claim 1, wherein from about 5,000 to about 10,000 variant peptide sequences are generated in step (e).

11. The process of claim 1, wherein from about 1 to about 10 peptide sequences are selected for synthesis in step (h).

\* \* \* \* \*